United States Patent 10,695,415 (LIVE ATTENUATED ORAL VACCINE AGAINST SHIGELLOSIS AND TYPHOID FEVER) - sequence listing, part 7

SEQ ID NO: 3 - DNA, 4802791 bp, Artificial Sequence (residues 1-1,600,931 of 4,802,791)
  Ty21a-Sso (wzz-), clone #3-1
agagattacgtctggttgcaagagatcataacaggggaaattgattgaaaataaatatatcgccagcagcacatgaacaagtttcggaatgtgatcaatttaaaaatttattgacttaggcgggcagatactttaaccaatataggaatacaagacagacaaataaaaatgacagagtacacaacatccatgaaccgcatcagcaccaccaccattaccaccatcaccattaccacaggtaacggtgcgggctgacgcgtacaggaaacacagaaaaaagcccgcacctgaacagtgcgggcttttttttcgaccagagatcacgaggtaacaaccatgcgagtgttgaagttcggcggtacatcagtggcaaatgcagaacgttttctgcgtgttgccgatattctggaaagcaattccaggcaagggcaggtagcgaccgtactttccgcccccgcgaaaattaccaaccatctggtggcgatgattgaaaaaactatcggcggccaggatgctttgccgaatatcagcgatgccgaacgtattttttctgacctgctcgcaggacttgccagcgcgcagccgggattcccgcttgcacggttgaaaatggttgtcgaacaagaattcgctcagatcaaacatgttttgcatggtatcagcctgctgggtcagtgcccggatagcatcaacgccgcgctgatttgccgtggcgaaaaaatgtcgatcgcgattatggcgggactcctggaggcgcgtggacatcgcgtcacggtgatcgatccggtagaaaaactgctggcggtgggccattaccttgaatctaccgtcgatatcgcggaatcgactcgccgtatcgccgccagccagatcccggccgatcacatgatcctgatggcgggctttactgccggtaatgaaaagggtgaactggtggtgctgggccgtaatggttccgactattccgccgccgtgctggccgcctgtttacgcgctgactgctgtgaaatctggactgacgtcgatggcgtgtatacctgtgacccgcgccaggtgccggacgccaggctgttgaaatcgatgtcctaccaggaagcgatggagctctcttacttcggcgctaaagtccttcaccctcgcaccataacgcctatcgcccagttccagatcccctgtctgattaaaaataccggcaatccgcaggcgccaggaacgctgatcggcgcgtccagcgacgatgataatctgccggttaaagggatctctaaccttaacaacatggcgatgtttagcgtctccggcccgggaatgaaagggatgattgggatggcggcgcgtgttttcgccgccatgtctcgcgccgggatctcggtggtgctcattacccagtcctcctctgagtacagcatcagcttctgtgtgccgcagagtgactgcgcgcgtgcccgccgtgcgatgcaggatgagttctatctggagctgaaagaggggctgctggagccgctggcggttacggagcggttggcgattatctctgttgtcggcgacggtatgcgcacgctacgcggcatttcagcgaaattcttcgccgcgctggcgcgggctaatatcaatatcgtggcgatcgctcagggatcttctgagcgttccatttctgtggtggtgaataacgacgatgccaccaccggcgtgcgggtaacgcaccagatgctgttcaataccgatcaggtgattgaagtgtttgtcattggcgtcggcggcgtcggcggcgcgctactggaacagcttaaacgtcagcaaacctggctgaagaacaagcacatcgatctacgcgtgtgcggcgtggcgaactcaaaggcgttgctaaccaatgtgcatggcctgaatctggacaactggcaggcggaactggcgcaagcgaacgcgccgttcaatctgggacgtttaattcgcctggtgaaagaatatcatctactcaatccggtgattgttgattgtacctccagtcaggcggtggccgaccagtatgccgacttcctgcgcgaagggttccatgtggtgacgccgaacaagaaagcgaacacctcgtcgatggactactaccatcagctacgtttcgccgccgcgcaatcacggcgcaaattcttgtatgacaccaacgtcggcgccggtttgccggtaatcgaaaacctgcaaaacctgctgaatgcgggtgatgaactgcaaaaattttccggcattctttccgggtcgctctcttttattttcggtaaactggaagaggggatgagtctctcacaggcgaccgctctggcgcgcgagatgggctataccgaacccgatccgcgcgacgatctttccggtatggatgtggcgcgtaaactgttgatcctcgcccgcgagacgggccgcgagctggagctttccgatatcgtgattgaaccggtgttgccggacgagtttgacgcctccggcgatgtgaccgcctttatggcgcatctgccgcagcttgacgacgcgtttgccgcccgtgtggcgaaagctcgtgatgaaggtaaggtattgcgctatgtgggcaatatcgaagaggatggcgtgtgccgcgtgaagattgccgaagttgatggtaacgatccgctcttcaaagtgaaaaacggtgaaaacgcgctggcgttctacagccattattatcagcccttgccgttggtgctgcgcggctacggcgcaggcaatgatgtgacggcggcgggcgtgtttgccgatctgttacggaccctctcatggaagttaggagtttaacatggtgaaagtgtatgccccggcttccagcgcgaacatgagcgtcggtttcgacgtgttgggcgcggccgtcacacccgttgacggcacgttgctgggcgatgtggtatccgttgaagcagcggatcatttccgtctgcataacctggggcgatttgccgataaactgccgccggagccgcgtgaaaatattgtttatcagtgctgggaacgtttttgccaggcattggggaaaaccatcccggtggcgatgacgctggaaaaaaatatgccgattggttccgggttagggtccagcgcctgttccgtcgtcgccgcgctggtcgcgatgaatgagcactgcggcaaaccgttaaacgacacgcgtctgttggcgctgatgggcgagctggaaggccgtatctccggcagcatccattacgataacgtcgcgccgtgctttcttggcggtatgcagttgatgattgaagaaaacggcattattagtcagcaggtgccgggctttgatgagtggctatgggtactggcttatccgggcattaaagtttccaccgcagaagcacgggccattttgcctgcgcagtatcgccgtcaggattgcattgcgcatggacggcatctggccggttttattcacgcctgttactcgcggcagccgcagcttgccgccgcgctgatgaaagatgttattgccgaaccataccgcgcgcgtttactgccgggctttagccaggcgcggcaggcggtgtcggagatcggcgcgctggcgagcgggatttccggatcggggccgacgctgtttgcgctatgcgataaaccggagacggcgcagcgcgtcgcggactggctgagcaaacattatctgcaaaatcaggaaggcttcgttcatatttgtcggctggatacggcgggcgcacgagtagtgggataatcaatgaaactctataatctgaaagaccataatgagcaggtcagctttgcgcaggccgtcacgcaagggctgggcaaacagcagggacttttttttccgcacgatctgccggagtttagcctgacggaaattgatgagatgctcaaccaggactttgtcagccgtagcgcaaagatcctctcggcatttattggcgatgaaataccgcagcaaattctggaagagcgcgtccgcgcggcgtttgctttcccggcgccggtagcgcaggtagaaagtgatgtcggctgcctggagctgttccatggtccgacgctggcctttaaagacttcggcgggcgttttatggcgcaaatgctgacgcatatcagcggcgataaaccggtgacgattctgaccgcaacgtcaggcgataccggcgcggcggtggctcacgcgttctatggcctggaaaatgtgcgggtcgtcattctctacccgcgcggtaaaatcagtccgttgcaggaaaaactgttctgtacgctgggcggcaacattgagaccgtggcgatcgacggcgatttcgacgcttgccaggcgctggtgaaacaggcatttgatgacgaagaactgaaaacggcgctggggttgaattcggctaattcgattaatatcagccgcctgctggcgcaaatttgctactactttgaagccgtggcgcaactgccgcagggggcgcgtaaccaactggtgatctccgtacccagcggcaactttggcgatttgacggcaggactgctggcgaagtcgttaggcctaccggtgaaacgctttatcgccgccaccaacattaacgatacggtgccgcgttttctgcatgacgggaagtgggcgccaaaagcgacgcaggcgaccctgtcgaatgcgatggatgtcagccagccgaataactggccgcgtgtggaggagctattccgccgtaaaatctggcgtctgactgagctgggctatgcggcggtggatgacactacgacacaacagacgatgcgcgagctgaaagcgaaaggttatatctcggaacctcatgcggcggtagcgtatcgggcattacgcgaccagttaaaccctggcgagtatggcttgtttctcggaacggcgcatccggcgaagtttaaagaaagcgtggagtccattctgggagaaacgctggcattgcctgaagcgctcgccgaacgcgccgatctgccgttgctttcacatcatctgcctgcggattttgccgccctgcgtaagctaatgatgacccgccagtaaccattgcgcccggtggcgctgtcgcttaccgggcctatggggtggtgccgatttgtaggccggataaggcgtaaccgccatccggcgatgtcgttactgctcgtagcgtttaaagaccagctcgtcttgtgtggaggtttcttcatcaaagaaatacccttcacggtcaaacgcggtaagctgttccggcttcgttaagcggttttcaataataaaacgactcatcagtccgcgcgcttttttggcgtagaagcttaccaccttaaacttgccgtttttctcatcaaggaatacgggcttaatcagttcggcatccagtttcttcggcttcaccgatttaaaatattcctcggaggccagattcaccaccacccgatcgccctgcgcctcaagcgcttcgttgagcttatcggtaatgatatcgccccagaattgataaagatctttgccgcgcggattctccaggcgaatccccatctccagacgataaggctgcattaaatccagcgggcgcaatacgccatacaagccagagagcatacgcagatgttgttgagcaaaatcaaaatccgcgtcgttgaacgtttccgcctgtaggccggtataaacatcgcctttgaacgccagaatcgcctggcgtgcattatccggcgtaaaatgaggctgccagtcatgaaaacgcgtggcgttgagatccgccagtttgtcgctaattcccattagcctggaaatttgcggcgccgaaagctggcgggcctgttgaataagctgctggctgtgatccaacagctccggctgggtatagcgggtcgtggccagcgggctttgataatcaagcgtttttgcaggtgaaatcagaatcagcatatccagtccttgcagggaattttctgcgactttagcaaaaaaacgccgcagagttgaccgatggttgcgattgtcggcttaatcgcgcgatgccgcatcccaggtatctggcgccagttgtggttcgatatccgggaagcgccgcggatcgaactgcggtcttacgcccagtttccgttgtcgcagataatcgccggcgagggtatacaccaccggtgagagcaacaaaatcgccgtcagattggtaatggccatacaggccatgatcatgtcagcgagctgccatatcagcggaaaactgataagcgtaccggcgatgaccatgccaagcgtcgcaagacgtaatagccagatggcctttgcgttatgtaaccgcagaaaaaagagattgttttcggcgtaaatatagttggcgacgatagaactgaacgcgaacagaatgacgataagcgcgacaaaactggcgccccattcaccggtcaacgaaaccattgcatgttggagaagctgaatgccttctgttgacgaatgggacgcgtgattccccgccagcaggataatcatcgcgctggcggtacagatgataatggtgtcgctgaatacgccaatcatttgcacaatcccctgcgcgacagggtgagggggatacgacgttgccgctgcggccgcattaggcgttgaccccattcccgcttcattagagaacatcccacgctgaaaaccgctggtaatagcctgggtgagcgtatatccggctgcgcctgccgcggcttcctgccagccaaatgcgcttttgactatcgaggcgataacgccaggcatttgctcaatatgccagaggcaaatgaatacgctgccagcgacccacaataacgcgatgaggggaatcagccattgcatcaggcgggcgacgccttttatgccgcggatgataattaacagggcacagaacgccaaagcaatgccggagataagcggcggaatgttgaaggcgaaatggagcgcgcgtgagacggcattcgcctgcacgctattaaaaatcaacccgtaggcgacgagcagaaagagggcgaaaaccacgcccatccagcgcattcccagcccgcgcgccatataccacgccgggccgccgcggaactggcctgtcgggtcacgttctttataaagctgggcaagcgaacactcggcgaaggaggtcgccataccaatgatggccgagacccacatccagaatactgcgccgggaccgcctgcggcgatagccagcgccacgccggccagattaccgctgccaatccgcgccgcgaggctggtacacagcgcctgaaatgacgtcaggccgcctggctgcgggctaaggctgcctttcagactgcggctaaattggcgaatataacgaaactgaatgaatccggtacgccaggtaaaccaacatcctgcgccgagcagcaggtaaatcattaccgagccccagagtatttcgttaataaaactgaaaaactcaggcattaacgtccctcttgttgatgccgacacgctttgatgatcctgtataagcgtgacccatgatgtagatgaccttgtcaggctaatattaacggtagtttaccataaatacggcggtatcctttaattgcgcatcaaccgtcggcagatacgcaaacagttcacaagggcagccaggtgcatgtaggcggttgcgctgtgagtgcgtcgtgttatcatcagggtagaccggttacatcccctaacaagctgtttaaagagaaactctatcatgacggacaaattgacctcccttcgtcagttcaccaccgtagtggctgataccggagatatcgcggcaatgaagctgtaccagccgcaggatgctacaactaacccttctctcattcttaacgcagcgcaaatcccggaatatcgtaagctgattgacgatgctgtcgcctgggcgaaacagcagagcagcgaccgcgcgcagcaggttgttgacgcgaccgataagctggcggtgaatattggcctggaaatcctgaagctggtgccggggcgtatttctaccgaagttgacgcgcgtctatcttatgacactgaagcgtctatcgccaaagcaaaacgtatcattaaactctacaatgatgcgggtatcagcaacgatcgtatcctgatcaagctggcgtccacctggcagggcattcgcgcagccgaacagctggaaaaagaaggcatcaactgtaacctgacgctgctgttctccttcgcgcaggcgcgtgcgtgcgccgaagcgggcgtctacctgatctcgccgttcgtaggtcgtattcttgactggtataaagccaataccgacaagaaagactatgcgccagctgaagatccgggcgtggtttccgtaacggaaatctacgagtactacaaacagcatggttacgaaaccgtcgttatgggcgcaagcttccgtaacgtaggcgaaattctggagctggcgggctgcgaccgtctgactatcgcgccggcattgctgaaagaactggcggaaagcgaaggggcgattgagcgtaagctctctttctccggcgaagtcaaagcgcgtccggaacgtattaccgaagccgagttcctgtggcagcatcaccaggaccctatggcggttgacaaactggcggatggtatccgtaagtttgcggtagaccaggaaaaactggaaaaaatgatcggcgatctgctgtaatcattaacgcgtggccctgatatgggtcacgctacctcttctgaaacctgtctgtccttcctttcgcagtgtatcattctgtttaacgagactgtttaaacggaataatcatgaatactttacgcattggcctggtttccatttctgaccgtgcttccagcggcgtttaccaggataaaggtatcccggcccttgaagagtggctggcatctgcccttaccaccccttttgagctgcaaacgcgactgatcccggatgaacaggcgatcatcgaacagaccttatgtgaactggttgatgagatgagctgtcatctggtgctgaccactggcggtaccggtccggcacgtcgcgacgtcacgccggacgcgacccttgccatcgccgaccgtgaaatgcctggttttggcgaacagatgcgccagatcagcctgcgctttgtgccgaccgccattctttcccgccaggtgggcgttatccgtaaacaggcgttaattcttaatctgcctggacagccaaaatcgatcaaagaaacgctggaaggcgtaaaagcggacgatggcagcgttagcgtgccgggcatttttgcgagcgtgccgtattgcatacagctgcttgacgggccgtatgtcgaaaccgcgccggaagtggttgccgctttccgtccaaagagcgccagacgtgagaatatgtcgtcctgaccgggagatactgatagtagggttattcctcccggtgcgggaggaataaaagagatttagtgcgcctcgccgattggcaaaatagtgcggccaaattgctcgtttagcacttcacccatcgccagataaatagcgctggcgccgcaaaccagaccaacccagcctgcgatatggatagttgcttcgttaccggtgatattgccgaccgccagcagagcgaacagtacggtcaggctcaggaaaacaaattgcagcgcgcgggcggctttcagcgtaccgaagaacataaacagcgtgaacacgccccacagacctaaataagcgccgagtagctgagcgtcaggcgcatccgtcaggcccattttcggcatcagcaggatagcgaccagcgtcagccagaacgaaccgtaagaagtaaaggccgttaaaccaaaggtattgccttttttatactccagcagaccggcaaaaatttgcgcgataccgccgtagaaaatccccatcgccagaataataccgtccagggcgaaaaaaccggcattgtgcaggttaagcagaatggtggtcatgccgaagcccatcaggcccagcggtgccggattagccaacttagtgttgcccataattcctcaaaatcatcataattgaatggtgaaatagtttcccagaataacgagttccgtattcggggcgcggcataataatcagggggaagaggactgtctatgatctaataagggggaaaagaaaatatttccccctgtgagggcattcacgcctgaacggctgccatcattcgtcgcaggcaggctatttgcaagaccgccggaatagtcacgcgatacgcgctgccgctcatcgctttgacgccgtttaatgccgcgccgaccgggccgccaagacctgcgccgcgcagcaatccgtggcccaggatgctcattgcggcatgggtacgtaaaatgcgggtaagctgggtggaaagcaggtgggagaccccttttgccagactgcgatctttcatgagcagcggcagcagttcttccagttcagaaactttggcgtctacggcttgcagaaattcctgcttatgcgccgcgtccatcttctgccaggtatgacgtaaaaaatgctccagcagttgctgttctatttcaaacgtcgacatgcttttatctgctttaagttttagccgttttgcgacatccagcagaatcgcgcggtactgttttccgtgtccgcgcaatttgttggcgatactgtcgccgccgtaatgctgaaactcgccggcaatgagctgccagttacggcggtgttgctccgggtgaccttccatcgctttgaacagctcgttatgactaaggacgctcgacaagcgagctttgcccttttcgttatgcgtcagcaaacgggcgaaatcggcgagttgttcttcgctacaatgctgaagaaagtctaaatcctcgtcgtgtaaataggtgacgttcattttcagtctggcttttggaatagaaataacagcgattaatcgtcgccaatgactttaagtctcgccatatcggaagaatttaccgtatgacctgagaaggtaatctttgatacgcagcgtttgttgtcgttatcgctattaatattgatccagcctgtcgtctggccttctttgattgaggaagggacgttcaggctttggctggcgctacgcgcagttttaaaatagacggatgcgccgctaagttcgatatcgccgtgatccgccgtgagttgaatgcgcttcacgatgcggcagacgggaattttcagcgcgagatcgttcgtttcatttctgggcatggcaataacacccagtattttatggtcgttcgcgtgcgcgacgctacttaacgccaggccgaaaagcaggccgacggaaatcgttaacacagatcgcatgaaatttctctttgacgggttcaataagcaattaccgtctatcatactctgctcatgacaacgattcagttttgtaatcttttctttttattacaatttttccgtgaatggtattcgttgtttaatttattttatgaatgtttacctgtctggttttccatcgcgccctctcgtcaataaaaaattttttcatctcccccttgatgacgtgggttacgaccccatcttgtagtcaaccgcagtggtgagtctgaaaaaaaacgattcagggtagttgaaaccgcacgtttcgcccttattacagattcacaaccacatgatgaccgaatttttagtggagacgtttagatgggtaaaattattggtatcgacctgggtactaccaactcttgtgtagcgattatggatggaacgcaggcacgcgtgctggagaacgccgagggcgatcgcactacgccttctatcattgcttatacccaggatggtgaaactctggttggtcagccggctaaacgtcaggcagtgacaaacccgcaaaacaccctgtttgcgattaaacgcctgattggccgccgcttccaggacgaagaagttcaacgtgacgtttctatcatgccgtacaaaatcatcggcgccgacaacggcgacgcatggcttgatgtgaaaggtcagaaaatggcgccgccgcagatttctgccgaagtgctgaagaaaatgaagaaaacggctgaagattatctgggcgaaccggtaactgaagcggttatcaccgtaccggcttactttaacgatgcgcagcgtcaggctaccaaagatgctggtcgtatcgcggggctggaagttaaacgtatcatcaacgaaccgactgccgcagcgctggcttacggtctggataaagaagtcggcaaccgtactatcgcggtttacgacctcggtggtggtactttcgatatctctattatcgaaatcgacgaagttgatggcgaaaaaacctttgaagttctggcaaccaacggtgatacccacctgggtggtgaagacttcgatacccgcctgatcaactacctcgttgacgagtttaagaaagatcagggcatcgacctgcgtaacgatccgctggccatgcagcgcctgaaagaagccgcagaaaaagccaaaatcgagctgtcttctgcgcagcagaccgacgtgaacctgccgtacattaccgcagatgccaccggtccgaaacacatgaacatcaaagtgacccgtgcgaaactggaaagcctggttgaagatctggtgaaccgttctatcgagccgctgaaagtcgcactgcaggacgctggcctgtccgtgtctgatatcaacgacgtgatcctcgtcggcggtcagacccgtatgccaatggtgcagaaaaaagtggctgagttcttcggtaaagagccgcgtaaagacgttaacccggacgaagctgtggctatcggcgcagcggtacagggcggcgtattgaccggtgatgtgaaagacgtactgctgctggacgttaccccgctgtctctgggtatcgaaacgatgggtggcgtgatgactccgcttatcaccaaaaacaccaccatcccgaccaagcacagccaggtgttctctactgcggaagacaaccagtctgcggtaaccatccatgtgctgcagggtgagcgtaaacgtgcgtctgataacaaatctctgggtcagttcaacctggatggcatcaacccggcgccgcgcggtatgccgcagatcgaagtcaccttcgatatcgatgctgacggtatcctgcacgtctccgcgaaagataaaaatagcggtaaagagcagaagatcactatcaaggcgtcttctggtctgaacgaggaagaaattcagaaaatggttcgcgatgcagaagcgaacgctgaatccgaccgtaagttcgaagagctggttcagacccgtaaccagggtgaccatctgctgcacagcacccgtaagcaggttgaagaagcaggcgataaactgccggctgatgacaaaaccgctatcgagtctgcgctgagcgcgctggaaactgccctgaaaggcgaagataaagccgctatcgaagcgaaaatgcaggagctggcgcaggtttcccagaaactgatggaaatcgctcagcagcaacatgcgcagcagcaggctggctccgccgacgcttctgcaaacaatgcgaaagatgacgacgttgtcgacgctgagtttgaagaagtaaaagataaaaaataatcgccctttgaacgggtaattactggcacgggcgaagaggtttcctctccgcccgtgtatgcatgttaagggcagataaaaagagatggcgaaaagagattactacgagattttaggcgtttccaaaacagcggaagagcgtgaaatcaaaaaggcgtataagcgcctggccatgaaatatcatccggaccgcaatcagggtgataaagaggccgaagctaagtttaaagagattaaagaagcctacgaagtgctgaccgatgcgcaaaaacgcgcagcctacgatcagtatggtcacgccgcgtttgaacaaggcgggatgggcggcggatttggcggcggctttaatggcggcgctgatttcagtgatatctttggtgacgtttttggcgatatctttggcggcgggcgtggtcgccaacgtgcggcgcgtggggctgatttgcgttataacatggatctcaccctggaagaagcggtgcgtggcgtgaccaaagagatccgtattccgacgctggaggagtgcgacgtttgccacggcagcggcgcgaaagctggtacgcaaccgcaaacctgtccgacctgtcatggttctggtcaggtacagatgcgccagggattctttgctgtacagcagacctgcccacactgtcagggccgcggtacgctgatcaaagatccgtgccataaatgtcacggtcatgggcgtgttgaaaagagtaaaactctgtccgttaaaatcccggcgggcgtggataccggcgatcgtattcgtctggcaggcgagggcgaagcgggcgagcatggcgcaccggcaggcgacttgtacgttcaggtccaggtgaaacaacaccctattttcgagcgtgaaggcaataatctttattgcgaagtgccgatcaactttgcgatggcggcgctcggcggtgaaattgaagtgccgacgttagatggtcgcgtgatgctgaaagtaccgagcgaaacacaaacgggcaagctgttccgtatgcgcggcaaaggcgtgaagtccgtacgcggtggcgcgcagggcgatttgctgtgccgtgtggtagttgaaacgccggtcggtctgagcgaaaaacagaagcaattgctaaaagatcttcaggaaagttttggcggcccgacgggagagaaaaacagcccgcgttcaaaaagcttctttgacggcgtgaaaaaattctttgacgatttgactcgctaacctttttcccgttgtatttttcttcagcccgggtgtatgtatatccgggctttttttctgcctgtacgcgcccaggcttctgctaaacgcatcgtatcctctcatttgttggtattttgttttactgataaacaaattgatgttaatcagcaggtttgcatacgctcattttaaaaaaaaatgtaatgtgatgacattaacgattgcttttttagacgctgtgaattgatttatcttgagtattatctatattgctttttttagtttccggaggcagacagcgaatgggatcgaaaggtgccaacaagagctttgattataatttaatcaaaattcttgacgctgttattttgtcaggaaatgcggctatggcggcaaaaaagttaggcattacaccggctgccgtttctctggcgttaaagcgcctgcagagttattacccggaagaactgtttagcagagggaaaggcgggctcatccccactgctaaggctgtcgacattcaccaaaatttcagtcaggtgatgaaactggtggatgacacatttctctgtaatagcaaaaaagatgaagcgttccagataacgttattaggcagtgatattgttgaaagctattatctttctcagctctataacagcgatatatttgaccgtattttgataaatcatttctccgtcagaaatatgagtcgggagcatatcagcgaacttctgtttactgcgcaaggcgatctgttgattagtgccgaacctttgctggagtccggcatagagaatcaaatcattgatagttttaaatcatttgtttgtatctgtagcagtaaacacatgctgagtaccctctcgcaactgtcgctacatcatttttattcttcgcgtcatgcgttatatcagccggggatgggggcttcagtgatatatcatgatagcgagttatttaaggatgagctttactatactggcaggcgtattgtcggctatcgtagtgattcacttaacggtttgatgagcatgatcgaacgaacctcattgattgcattgatgcctttgaaattagcgcttttttataaaaatcatcgtaaatatgacattaaatttattcagcctccgcccgaactggcctttaagtcagttcaggtctatgcatcctggaagaaaaatagtagaaatatatcgacgattaatgagatggtaagtatgttgcaaacactttcctccttccgtcgctaacacacctcatttttacgctttgatttaatatggttttaaatgatgtgctttgatttttacccttctgacagggcgcttacactccttgtgttaattattcatttataatgatttcggggtgttaaaatgtctattcccaaccatgtgtcgacaacggaagttgtgctattggagctagagatcttactcactattatttcgattggcgcgtggggaggctttgttagctatcttttacgcaaagataagacagaatataatagttctcatgaaagtattaaatattgcttaacgcagatcgtgatttcctgcttcaccagctttttgttaagcgcgattgcgatcgaaaaagaatgcagtttcaatattgtcctgttggcggcaggcttaggcggtgttttcgcgagtccgatcttaaaaattcttgggcggcgaattaaaaaaattatcggaggaaataattcagattaattgtcattcgcaatatcaggctcatccgtgagccttttacgcgtcttttttcagcctggtctaggtcactctgttcttgatccagccataaataaattgttcgttattgtggtttttctcagcaacgtttaagtagtacatgccctgactgcaattgagggctttcaccaaaacggcttccccttcctggcctcgccaggccaaataatgttcgagagcggcaagcgtccgcgggccaatattgccatccacatgaacatccgggtagcgtttaccttcgtgattaaagacgttcagccagcgttgcagccacgcgctggggtggtaatcgcctatgttgactgccgcatcgcacagctcgaatgagactggccacgatagcgtcgagatgacatcaaagcctggttttatccagtaatcctcttcgagaatcgcgtaggcttcagcgtgggtcagatcccgcatatcgccagcatagccatgcgctcgcgccgtggcttcggtaatgccccaatgagtggcgccgcctttatctttagggttaaatacgtaaccgccttcaagcgcaataattccatctataattggattcatcttccctttccttcgcttagtgaatatgcagatacatgagagaacctaacgttactgaaaatacggtcgtcagggcagcgatggtttgccgtacaatctgtttttttcttccctttgtttcgctatccgtcgcgataatggcgatatcactattcactttgagaccttgtcttggaatggtaataaaaagatcattaataccaagcgctttaaggtcacgtctgattaaatagagaatctgcgttagatttgcatcattaacatagtggcttcgacttccccataacgcagtggttattttttgtcgctcgataatctccagatgagcattctcgatgatgaaactgagacatttggctctcatcgcagtcattttaataacctgtgaatttgagaccgtcctcagttcatatttaccttcattgtaaatgcaattgctattaatgatataagttttcataacgtcttcctttagaaatgtacatcctggttgtctgtggtgactatattgtatgagaaatgtcttaatccaataaatgtcactggttttattgtattgtcattgtctatagcgagtgtaatcacattatttcattgtaattaaatgatatttaattacatgataaatgatatttactatgttctcaccagaacggagtaagcgggcgctgagaggtgttgttttctcttcgtcagacggtgttgttaacctcatttttatgatttttatatcatctaaaaaggtgatgttttgtgattagctattttttatgcctgtagcgattatggaccccgcagaacgagctgcgacaattttgaaacgtaaaaggaaatttgaaaatggctacaagcaaactgattcaaggcgatacgattactgaaactacccatgcagcgaatggttttgaccctgcaacaagcgatgataaaataagctatacttccgctcgtgttgcgaaaccggtatacaataaatataaaaattccacgactaagccgaaggtattcggttattacaccgactggtcacagtatgacagccgtctgcaaggcaatatgtcccaaccgggccgtggttgtgatttaaccaatgtttcaccgacggcttatgacaaactgatttttggttttgttggtatcaccggtttcagaaaaattgataaagaagaccgcgacgtcgtagcagaagcggcagcgctgtgcggcaaagtgaaatatgagccgaccttcctcgatccgtggggcgatttccagtcttatatcaacctgggttttgaaaccagcggctgggatgttgatccgaaaaccgtgacccaggctaacgctaaaggtatgctgggcgcgctgcgtgatatgcaggcaaaagcgaaagctgcaggtcacacgctggcgctctccatgagtatcggcggctggagcatgagtaacgggttccacgaaaccgccgcttctgactcttctcgtaaaaccttcgccaaaggcgtggtgaaactgttcaaacagttcccgatgttcagcgaagtggatattgactgggaatacccgaacgatgaaggggcgggcaacccgtttggcgcagaagatggcgctaactacgcgctgctgattgccgaactgcgtaaacagctggattccgcgggtctgagcaatgtgaagatctctatcgcggcctccgcggtgaccacgatttttgatcacgctaaagtaaaagatctgttggctgctggcctatacggcatcaacctgatgacctatgacttcttcggtacgccgtgggcggaaacgctgggccaccacactaaccgcaaagcgctggaagagggcggctgggctgtcgaaaccatcgttgatcacctgctggcggaaggtttctccgctgaccgtatcaacatcggttatgccggctatacccgtaacgctcgtcaggtagaaattgaatccctgtcgccgctgaaaggttcttacaacccaggttcaggcgatactaccggttccttcgaatccggcaccagcgaatggtatgacgtcatttatagctacctggatctggaaaaccagaaaggccgtaacggtttcaacgtttacaccgaccaggtcgctgacgctgactacctgtatagcccggaatccaaactgtttttatccctggatacgccgcgtactgtcaaagcaaaaggcgaatatgcagcgaaactgggcctgggcggcgtgtttacctggactatcgatcaggacaacggcgtgctggttaacgccgtgcgtgaaggtctgggttatgaaatcgaatctgaagttatcgatatggaaccgttctacttcgaaggtatcaatgtagaaaaagatgacgagcagagcgatagcgacgacgcgcagaaggtcaaccacgcgccgaaagcggcgattgaactgatggtcgtaggcggatcgacggtacagctgtctggcgcaggttcttctgatgaagataacgatgagctgtcctttagctggggcgtgccttctcaaatcgatgtggcagacaaaacggcagaaatcattgaggttgtggtaccggaagttagcgaaaaaacagcctttcagttcaccctgtttgtacgcgactgctacaacgaaccgtcctctcaacagcgctttgttctgacggcggtgcctgcgctatctcaggttcaaccggaaccggaagaggaagaagagattatcgttcctgtaccggacgaggaagaagagaccacgccggctgaggatgatacgtcagcagatgacaaaacgtcaccttacgcgcagtgggatgcttctaccgtttatggcgcaaactggggttctttcgaaatcgttagctggaaaggccataactatcaggtgaaatggtggtctatgggcaaccagcctgacctgaactgtggtgtcggcggtgcatggaccgatcttggcgcttactaatacacggtattaagccgatgtattgggcttcatgattcaagccccggtttaccggggcttttctccaccagggacagaggaagagcagaccatgaccatttccatccatgccagcgcatttgacgtcaacagctggtatcaaaaaatcaccttaaccttcatcaatgagagcggtaatccggtcgatatgaaccatgccgcaatatcattcacggcttccgggcacatcgatccatggggaaatagcggcggtacgctcaaagggaacccgccgcttacgctgaatgatagttcgtatggcacgctggaaactaacaacatcatcattaataacagcgatgcattacttcttcagccgggcgaacgcggaacgctctctttcagcctcgcggcgacgcaggtgccggtaaaaatgtccgccgtcaccttgacgctggcgtcatcgtcatccgaagacgcagagtctgcaaccccatccgatcaggagacgccagcgatacccgccgcagacgaacaacccgccgaatccgatgtgccggaaaaggacaatgaccttcaggaacgcggccttacgcttaacgttagcgagttgaatgccgcaagttggtatcaacacgtcacctttacgctgaccaacctctacgcccaggcggtagatctcaatcagcttcaactgaattttacggccagcgcgcaccccgatccctacagtccgtttcagggaacaatgctggggaatcaggccgtgacgctggccagcgatgggggatggcccatcgagaagaataccatcaccattaatcatgacggcgcgctgatgctggcggcaggggatatcgccgaattacagtgctatctggccgccacgcagacgccagttgccatcagcgatttgaacgcgacgttggcccatgaccctgcccaccagggaaaaatttgcgttcactttcctgccatgacgcagaccgtggcgctcaaaccggtgattgagctactgtttcctgccggcgaaacccggcgctttgtcggtgagtggggagaggttctgacaataagcgatcttagcgcaggaacgtatcggcttatcgtaccggtactggcgaatgatgagatgcaaatcgcgccagtcgagtcctcttttaccgttacgctgcaatccggagatgccgccgcgcaggtctaggtatcttgtttaccgattgtccattatgccagcgcgcgtctgatgattgatgcccctgcgcttggtaatgcgaaattgaccgttgaaatcgccgatgctacgcaagcggatgagcgtaccgtcacgcttatcgccaaccaaccgcagttaatcacccggctactggcggggcatcattatacggtcaatctgcagcctgcgatgattaataaccgctttatatcggcacccatacagcttacgggttttatccctgctgcggcgcaggttgccgaggttgctgtcgcttaccaacagtcggcgctcgacacggcgagcttcgtgacggtagatgccactatactgggcctgcccgatggcgtcgcgccgcagcgttatctgttcagcagcggtaaatatcaatactcattaatgctggagagcggcagcgatcggcagacgctgtcattacgctttgcgcccgggctgtatgatgttcagacggacgatattttcatcgacagtgtgccgtggcgttgtgaacaggccgggccgctacgcttgttgcaaaaggtcaaccatgtggcgctggagtttctgcccggcgtgacgctacaggtaaaaggttggcctgattaccttgctcatggcggcgtgacggttaacgcgccagagacggtttctctttatcgcgatataccgtttagcgcgttgtttaaatacgacggttttgacggcggcggcgatccggtgccggccgcagaggttgacgtgaacggggatgtttttctggattacgcgacattaccgatccataaaaccgttgcgctggtgcgccagatcgaaaaagaagccgggcgtagcgtcatgccggtaatggtcatttataccgcgaatgccagcggcggcagcgcgctggtggatttacaggatgcgcaaaagctacgtaaccattttggtaactttattacccagtgtctggcggcgcagtcatacaaagatgagacgcatcctgtcccggccacctttgtgcttaacccggattttctgggtgcgctacagcaaggaccgtatggctataccgtagtacggcaaaaaaacagtgtgccggtgaatgcccaactggcggcggcgatacaagcattaccggcgatggctggctttatcgcgccttcgttgccgacgtttagcgacgatctctacggttatattcaggcggtgaactatcttgttcgtcagtttgccccggatgtggcttttggctggcagacgaatgtctgggcgacaggaacggcggactgggtgctgcgcgataccgctgatccggtagctgaagggcaggcgatcgccggatttattcatgaactgggcgtttatagcggagaatatgcgccggactttattgcgtttgatgaatttgagcgtgactgtttcagtcctgatgcgcttgcccactatggctggaatgcgacatgctggcttaattacctggcgatggtaaaacaggtgacgaaagcgctgctgacgcccgccatgctgtggcaaattcctggcggccatatgcctacagtagaagagggcgtcagcaaaatcagcgctgcgcactttgcatccggcggaaccttttttatgggtgacgcccgcattggcagcgatcctgacacgctctctttgcagctactcaatacggccttaaatagcgcgacttacggcgtcccgaccgtcggcgactttttacgtaaagataaagggtatgactggggccagatgcaggcgctgaacctaccggactttaacgtcttttcgatcttatggggcggtggttctactatcagtattacgacaatccattctaacggtgaagacggcggctggctggcggataaaatggtagagtattatgctgctccacgctattttagataatatcactgcttatttgcattaatctggcctattagtttgagattcgaaggcgcgttctttcgaatctcttttcctgcgccccctgacctctcattctttatgcgtaattcgttattaattttctgtaatcaatttgtattaagaatcgtcttaatcttaaaaatattgcgtattagtgcgttgtgaatacagaaatactgcatagcgatgttatttattattaatttaagtactttttgagaggttatactgtggcgctacattgagtagacaaccgttaatgaaaaaaatgatgaacgacgcttttgctaaagataataatgagaatttattacactcttttcttttttctcagcaggctaaacctcacgcggcgattgatgccttattttcggccttgttgccatttggtcaaccgtttacgctgggtatcggcgatgagttttatttacaggccaatgatgaacactacattgtattactggagtcaggaattgtttctttctgtcgtgatgacaaccgactccatatatcttcatcgtttgcgccatcggtcgtgggtatggttgacagctatggcgctacctataacgttcccgcgcgcccggaacactttttgctcgcagaaacggtttgtagcggtagatttgttcgcctgccggattttataaaaatcgccgatgaatgcgatttgtggcacgacgtggcccgttgtctggcttaccgtctgatggtgatgagcgcgcgcgatcgtgaattagtcggcgtcgattcttacctgaaagttcgggcgctgctgattgaaatctgggcttatccacaggcctaccgggaaaacattatcgtattgaattttattcaacggcgtaccgggatatcgcgcagtcggactatgaagattctgtctgaactaaaaaaaggcgggtatatccatattgataatgggcggctgacggcactcggaaaactgccagtggcgtattaatgcactatacgcaacgatatatttacatatctcaactgaatttgcctgttatcgttaataaaatgttttattgaaaattgttaagaagattatttttaaaaagtcaatatgactaaaggagataggccgaacggctggtgtaaagtcaatataaaacaacatgttacatctagtcctttaaaaccaaatgtcgatgattgcaacttgccgttggcttgctaataattaataacatcgttatctcattataacgtaaagattaactcacgacgttgagtagctgttttattgcctctgacatttatatcagaacaagaagacacttttttcgcataagaaaagtcgtgatattgctgtgaagaaatatcagcagccgtttcgttaaaaaatctgattaccctcatttttatatttaaaaggagcttgaatgaaaaagcctgtactagcattaatggtctctgccattgcctttggcggaatgttgtccaccgcgcaagcggatactacaaccgtcactggcggtacggtaaattttgtcggacaggtcgttgacgccgcctgttctgtttccgctgactctgtcgatcagaccgtgacattaggccaggttcgcgccagtaaattaaccgaggccggtatggcggcgaatcaaaaagaagatttcaccattaaactggaagactgcgatactcagaccagccagaatgcggcggtgatttttaatggccagcaggacgcaaaccagccgggttcgctggcgaataccgctggggcaggttcggcgacgaatgtggcactacaactttatggaccggatggccaggcgctgaatattggtgaatcgtccagtactgttaccttgaacgatggcgaaaacgttattccgcttagcgtggattatatcgctaccggtacggcgactgccggtaatgttaccgcgacggcgacatttagcatggtttattcctgattccttatcgggatttttttctcgtctgttgggaggcgagaaaggggcgttacgcgcgtcactgcgcgtaacaaaccgacggcatcaggatattacgcagatgaaaaaaaacgtaccgattttccttcgattattgctactgctgtcggcggccggcctgtcgtttgccgtgcaggcgggaggcattgcgctgggcgcgaccagggtgatttatccgcagggaagtaagcaaacctccttgccgattattaattcttctgccagcaatgtttttttaattcagtcgtgggtcgccaatgccgatggttcacgctcgacggattttatcattacgccgcctctctttgtgatccagcctaaaaaagaaaatatattacgtattatgtatgtcgggccgtcattaccgaccgatcgcgaaagcgtgttttatttaaacagtaaagtgataccctctgtcgataaaaataaactgaccggcaactccctgcaaattgcgacgcaaagcgtgattaagctatttatccgcccgaaaaatctggcggaggcgccagcccatgccccggcaacgcttcgctgccgtaacgagcgcggccagctaacgattactaacccttcgccgtactacgtttcgatggttgaactgtacagcgcggggaaaaaactgccgaatactatggtaccgccgaaaggcgcgatcactctcccggcgacgcctggccaggtatctttgcgcacggtaaacgattttggcgcaacgacgccagcacgcgtttgtccagcttcatgatgttatgcgtaatcagcttttcatgacgcgatattactccagcgtagctaaacccgtattaactccgctggcgttggctatcgcactggcgcctgcgcctgggtgggcggaaaactatttcaacccggcatttctgtctgacgacccgtctgcggtggccgacttatcgaccttttcccgtaatgcccaggcggcgggaatgtatcgcgttgacgtttacctgaacaatacgtttctcgcgaccagagacattgccttccaggcggtgaagacgacgggaaaaagcgcgcccaccgatgacagcggattacgcgcctgcctgacgcctgaaatgcttaaaaatatgggggtaaacaccggggcatttccactgttggcgaaggcggcggcgggaagttgtccggatctcgccagtgcgataccggccgcccggacccgctttgattttgcgcagcaacgtctcgacattagcatcccgcaggcggcgatggttgccagcgccagaggctatatcccaccgcaatactgggatgaaggtattaacgcgttgctattgaattacacctttaccggcgcgaatagtcaggatcggagcccaggcggcagtgcggagaacagctattttcttggattgaatagcggccttaatctgggggcctggcggttacgcgactactccacatggaacgcgaatagcggcgatcagaatagcgacagcgactggcagcacatcagtacttatctggaacgtgatgtggtctttttgcagggagaactgacggcaggcgatagttataccccctccgcattattcgatagccttccttttcgcgggctacaactggcgtctgacgacaatatgttgccagacagcatgaagggcttcgcgccgaccattcacggcattgccagaagcaacgtgtaagtgaccattcggcaaaacggctacatcatcaatcagcgctatgtgccgcccggggcatttactattaatgatctctatcctaccgccgccagcggcgatttgactgtggaagtcaaagagtccgacggttctattaatcgctataacgtgccctattccgccgtgccgattctacaacgagaagggcggctgaagtatgcggcgacggtggcggagtatcgtagcgatagtagtcaaaaagagaaggtgaaattcagtcaggcgaccttgatatgggggttaccgcatggttttacgctgtatggcggaacacaactttccagtcattatcacgcgctggcgatcggcagcggcgcaaatctgggcgactggggcgcggtgtcgctggatgtcacccaggctaccagtacgctggcggataataactcctaccaggggcaatcgctgcgtttcctgtatgccaaatcgcttgcacagtcaggaaccaatttacagcttatgggctatcgctattcaacctcgggcttttacacgttggatgataccacgtggaaacggatgagcggctatgacgatgacaatcggactgacagcgataaaagcaggccggaatgggcggattattacaatctttattataccaggaggggcaaagtacaactcgatatcaatcaacagctaggcgggttgggatcgctttttattaccggcagtcagcaaagttactggcacactgatgaaaaggattctttgttgcaggtgggatacagcgatacgctggcgggtattgcatggagcgtttcttacaacaataacaaatccgcaggcgatgcggagcgcgatcaaattttcgccctgaatatctcggtgccgctaagtcaatggctgcaacatgatgatgaggtcacgcaccatcacaatgtttacgctacctttagcaccagtacggacaaacagcataacgttacgcagaatgcgggccttagcggcacactactggacgaaaacaatcttagttacaacatacagtaaggctatcagaatcacggtattggcgaaagcggcgccgccagcctggaatacgatggggcgaaaggcaacgccaatattggctataacgttagcgataacggcgattaccagcaggtgaattatggcctgagcggcggcctggtggcgcacgcgcatggagtgacgctaagccagccgttaggcaataccaatattttgattgccgcgccgggcgcagccaatgtcggcgttgtcgaccagccgggtattcatacggacgcgcgtggctatgcggtggtgccgtatgcgacgacatatcgccaaaaccgtatggcgctggacgttaacgccatggctgatgatgtcgatattgatgacgcggtgactcgcgttgtgccgaccgaaggcgcgctggttctggcccgctttaaagcgcgagtcggcgtgcgtgccctggtaacgctgaatcataatggtaagcctgtaccctttggcgcaacggtgacggtgaatgatcgccatgcggaggcgattgttgacgaggccggggaggtctatctttccgggttgtcagcgcaaggcgttctgcacgttcgctgggggaacctgccggatcaacagtgcgtcgcgtcctatcatctctcttcctcccgtcagattctgagtcgacaatatgcggagtgtcattaaatgaaaatacctcttttatttgctctgctggcggggagtgtcgtatcgcagtacgcacacgcagacgtgtgtaaaaacgttaacggcgtgccttccagtattaattacgatttaacgaccactctgacggcagaacaaaaccaggtgggaaagacggttcaactggaaaaaagccaggaagttaatgtacaggcggtgtgtcccgccggcgcgtcgacctatagccagacttatcgctcctatgtgtcgccatatccggtcgtagaaacgagcggtaactggaaatatttaaagctgggcccggactaccttgaaggcggaatgcgaattgaggattcttcggcgggcgatatctatccgccaatgaacaatgtcctgatgggatatgatgaaaatgtgaaagcgggtcaaccgttttacgttcgtgactcaaatctggagtttcagctcaaaattgttaaaccgttcgtcggcacggtgaatattagtcctaagactatgttcaatgtttatgtcatgaccgccgcaggcgatccgctgacagatgtcgtgtacagcattctttatagtggaacggtgaccgtaccgcaaagctgcgaaatcaacgccggacaaacgattctggtgaatttcggtgcattatacagcggcaatttcaaccatgcaggccaaaagccggagggggtacgagcgaaaaaattcagcgtaccggtaaagtgcagcggtctggattcgcaggtcaatttaacgatgcgtcttatcgctacgccggatagccactttccccaggctatcgcttcggataatgccgatgtcggtgtagtggtcgaaaccgatgaaggaaacgcgcttattcccaatgatgtacagagcgtcgcgccttttatcaccgatagcgccggacgcgctaacatcacattgcaagcctacccggtgagtacaacaggtgaaacgccagcggaaggggcgtttaccgccctggccagcctgcgagtggactttgactaaatgaacagatcacactgcgctctttttgtcatgggactaatcctgtgtccacaaatcaatgccagcgctgacgacctcgcttataacctcgaatttaccggcactattgtggcgcaaacttgcgacatagatatttccagtctcagtcaaagtattgatttagggcagtttgcagttggcgattttccttcgacaggaacaacgacaaaatttaagccctttaatatcaacctcaaaaattgttcccgaggaattaccggggcgaagatctggtttaccggcgaacccgatccggacaatcccgcgctactggcaataaccgataccggaatgggaagcggaaacatgttagcaagcggggtaggggtggaaattctgaatgatgatcaggataccatcagtatcaataatgccgactcagtggtctatccgttgaaagccggacgcaacacgctgtctttttatattcgctataaatcgacccggccgacggtcacgtccgggaacgcgacggcggtcatgtatttcgatatgcagtatgaatgaggagccatcgtaattatgcgtaacgatatcctgtacggcatcgggatgctgctggcggcatccggcgtccaggcgcacgatggccgggtctatgtctccggaaccatcacggacaatacgtgttcgctctctccaggctcggaaaatattaacgtggcgatgggcgcggtttctcaacggcagttttatcgcgcgggcgacggttccgcctggcaaccttttgctatcgatttacagaactgcggtagcactgccagcggcgtaacggtcagttttagcggtgcaggggatagccgtaatacggatttattggcgcttaccgcaggggaaagcgacgcttcaggaattgggattgcgctttatgatcaaaataaaactttaatcccactggggcaggagagtgatgtggtgacgctcagtccgggccaggcgtcggcgcatctgcaattttacgcgcgttatcttgccgatggcggcacggtaacgcccggggacgccaatgcctccgcaaccttcattcttgcctatgaataagttctttttacactgcgcgatatattggtgcttgcttcccatatcatgggcgcaggctggcgtggtaattggcggtactcgctttatctatcatgcgggcgccccggcattaagcgtaccggtaagtaaccattcagaagcgtcctggttaattgatacgcatattttacctggtggccgctggcctggaaccaaaaacgaagggaatattacgcccttcgtggtcacgccgccattatttatgctttcagcgcgccaggaaaactcaatgcgggtggtttataccggcggaccgctacccgccgacagggaaagtctgtttaccttgagtatcgccgctattccctccggtaaaccggaagcgaaccgtgtacaaatggcgtttcgttcggctttaaaattgctctatcgccctgagggactcgccggcaatccgcagcaggcctaccggcatctgatctggtcgcttacccccgatggcgcgacggtacgcaatccgacaccctattacgttacgctctttttattacgcgctaacgagcgcgcccaggacaacgccggggtcgtggctccctttgcaacgcgtcaaacggactggtgccggcacgcggttcgctgcactgtgcgctggcaaagtattaatgactatgggcgggtaatgacagcgcaaaccgtggatctgacgcgtattcattaacctatttttcaggcgtctcccgatagcgggaggctttccgatcttatcgaacgagacttttattatgtattatcacgcgttaaaactttcccgactggcgatgttgacgttggcaggcgttgcagtatccgcctcggcaatcgccgccgattctgccccgacgtcgcaaattggcccgacggcggaagcctacatcgtcagtcatccggataaagtgggagaggtggtggcaacgtatttggccgaacatccggaatttttggtcgccgccagcgagacgttacatcagcgtcagcagattgcgcaacaacaggcgtatgttcaactggcattacagtatcgtgctgagttgctcagtagcagcagtccttccgttgggcccagcgaggcaaaagcggcggtggtaatgttctttgattaccagtgctcgtggtgcagcaaaatggcgcctgtggtcgaaaacctgattaaggcgaacccggatactcggtttattttcaaagagtttcctattttttcctcccgctggccggtatccggactggcggcaagagtcggcgaacaggtatggcttacacagggcggggcgaaatatctcgactggcataatgcgctttatgccacagggaaggtggaaggcgcgttaacggaacacgatgtctacaccctggcgcaacattatctaacgccgacgcagctggccgccgtaaaagaagcgcaaagcagcggtgcagtacatgatgcgctcctcactaaccaggcactggcgcagcatatggactttagcggcacgcctgcttttgtcgtcatgcctcagacgcaaaacggtgatgtaaaacgggtgaccgtgatcccgggaagcacgactcaggatatgttgcaaatggcgattcagaaagcgaaggggtgatattcgctcagaggagaacgcacaggagtgaaagtaaaatgaagtctatgcgttgcgtcataccggtgattttactttcctttatcgttcatgaagggacagcgaaaccgaccgctcagattcattttatgggatcggttgttgaggcaggctgctggaatgacgtgggaaccttagaaattcaatgctataataaagagggagttgaacgttatattattgtcgagaatattatcacgccgatatcgtctcctcatgcaacggtaaaacgagattatttggatgaagataagcaattaacagtgctacgcattgtctatgactgaaccgcgtagcagaccgcaggtggtgtcccgtcagtgtcgtgtgaggatattatgaaaaatgttctcaccttcccgggacacggtctacagactttatcttcagataaacggcgctaaaaagaaaagtacgatcaataaaaaaagagtgggaataccaatagatataattttattacatcggtgagtatgatattgaatagcttgtggcggtatgtcagcagcgtcaatgataaatctttcatcgatttttatcccctgcctggggagcgtaacgaacagttcgaaaagcccgatttgttgtaaatctcgtcgcagcagataaagaagttgcgtcaaattagcatcgctaacaaattgacttcgctctccccaaactgcgtgtgaaatcatctcccgcgtaatcagtttcttgtaggcattttcaaaaagatagcttaaacaacgcgcacgcattagcgtcacctttagcacttttttatcatgtaatgatattatttctcttaacgactcattataaataaattcgttattaatagtatattgtctcatgaattcactccgttttgatattcataaggtacgtttcacactgtcagtgtgttcactggcggtaaagtactccttacatcagtacggataagtgtagagaaccgcaaagaaataagagaatcatttgtgattaaacgggataatattatgcttttttacttttttataaaatgtgccagatgtttttgatgttttttataaaatagcatcatgtgtttttattttacacaggctgaaatgatatcaataaaattataatttaataacaaacagatagaggaaatgatttacttattgaaataagtgtggtgcaaggttaatctgcgccttaaatgatggtgccagattataccagccaggataacctatatgcggccaataaaaaatgctaaaaaaattgactacaatctgatcaaagtgttcgatacggttattactgaaggaaatgcaaccagggctgcgaggaaactggatgtcacgcctgcggcgatctctcaggctcttcttcgtttacaaaatctttatggcgaagagttatttatcagaacccgcaaaggattagtcccgtccagcaaaggtaaatcgcttcaccaggtatttcgccaggcaattgaatctatagaaagcacactgtgcgataaaacagatgcgcaggagagtaatgaactcattgttctgggaagtgatatcactgaaaattactattttccggcattgctggatactgtgttgatgaatcgatatattattaaacactatgcgattaaaaaaacaggggaatactcgccagcctccatgctgacgcatggctatgcggatatcatcatgggaattctggaaattaagaatgagatgatcgaaagttttcttattgataatttatctgattttgtttgtgtttgtggtgaaaaaagtccattggttgggcttgaaaaaatgtctttatataatttttatgctgccagacatgctgtctatcattcagatatgttctcttctttcaatgctgatagcattgatttattcaagagcagtacgccttatgcggggcgcagggaaataggttattatagtgattcactatttggcgttatcggtgttgttgaaaaaagcgatatggttgcgattttgccaggaaaaattgctacttattttagagatgtgcggcgttataatataaaaatactacgtatgcctgatgaaataatttttcgtacattacccgtttatgcttatctggctacaaatagcacccattataaaaatgccaaaaaactgatatcaacatttcagtcgacctttctttttagccaggaaaaacagcctgacgctttggttgaaggaagcacatccttatgcgattgatctgtttaatatcaaattactgtattaaataaataaccattatgaccatggtcagtaaagcaaaaaataatgctatatatttatccccttctttttttaaagaagaggggaggtttttgttttcattgctgataataatgttggcatctactttaatacccgttcgaggcaccgtggaaaaaactggctcaagccaaagcctttaaggtcgcgccgcagtagatataaaatctgggtcaggttggcgtcgctgataaattgacttctttccccccaaagttcattagtgagttgttttttataaataatctcttgttgtgcatgattcagcatatattccagacactttatgcgcattgcggcaatttttattatctttcccgtttttatgttttttagctcattggtcttatcattgtaagtgtgcgtgctgttaattaaataaatagtcatgatgttatttaatgggtttaattggggtagcgataataatatgcatattaaatttgtggatcaactggcgtgattgtaatagcgtcttttttccagagaaaatcgtatcgtgtcacaaaaatgatggttttttagaaaaactaaaattttatttttagtcgttctaaaaataaaatgatagtagtgttaatttttatcagtagattgatatgctttgattgatttattgttgacataaaataatttgaattatggcgcaaggcctatgccaaccataaaaaaggtataggctattagtcacaatgcattaatgctacataattgttatgcttttatattagcgccagggaaataaaatcttcggacaataaagaatagttttagtctgggtgttattttatggatattttattttaaattattaaaccgatttctcttgttgacgtagggttatttgctaagcaacgggctggcttgttgtggccgctcgttgtctatatctgaattaataaggaaaaacgtatgaataagaaaaattcgtcaatggttaacttgcccgcaccgcgtgagtcgattaaccagaaaatcgataccaataacgcattggtgttaaatcataacgccatatatgaacaacgattagcggagatcacgcaatctaatacctgtgacaaggccattgtcaccgtaaatccctacgggaccgccccgttgagtctctatctgggaatttggattgatgaagctgccgcgcttgagatcaatgttgttgatagcgaagcgacgacagaggcagtgcgttatcaatatgatgtacatccgggcgctaaccttattcctgtgtgtgggatggtatccgcggtgaataatcagattaccctacgccttgcctcgcaaattgtcgggcaatatacagtaatgactgacgcattaccgcccacggattcggctaacgtgagcctcggcttccccattattagcgtctcctgtcctgcgcagcaggcctcgctgatggaggaagggctttatttctctacttattttgatcggtataatctggcttttgatcataacgggattgtccggtggtatgtaagtcaggaaatcccttcttataattttgtcagaatggataacggccatttcctggcgacgtcacagggaataaaccattgtctgaatatgtatgaatttgacattatgggacgggtttatacggtttatcttctcgacaatgagttccatcactccattcttcccattgagaacaatctggcgattgcgccttcagaatatagcaatggacggccagatggttactcaaccgggaaagatggcgtttctattattaacttatctaccggacttgaagtcgcctattacgatatgctgtatgtgatggattattccagatcgccgcgtccttccggaagcgcgccaggtcaggacgtatcaatggatgactggctgcatatcaaccaaagctatattaatgaacccaacaatttgctgatctgttccggtcgacatcagagcgcgatttttggcgtaaatgtggattccggcgaactgcgctttattatggcgaaccatgaggattggtctgacgaattcaagcaatacttattaactcctgtcgatgatgatggcgtcccgctgtatgatcttacctcgccgggagggattgatgcggcagataagaatttctggacctgggggcagcataacattgttgaaattccaaatgatgagcctggtattctggagtttatggtctttgataatggtaactatcgttcacgcgaagatgcgaaaagtttgttgccgctcgataacttcagccgggtggtgcagtttaaaataaacctaaacacgatgaccgtaacgcgtccgtatgaatatggtaaaacggaagtcgggaaccggggctatagcagttttgtgagcgctaagcatttattgactaatggtcacctggttattcacttcggcgcgacgacggttgatgagtttgaacataccattaccgcgcaaccaggctccagcgatcttgtcgatccggatgaagggcaacaggcgttaggtcgactggtattacaagaaatcaataaagagacgaaagaggtcttattcgaagcgatggtgacgtcgggctatttcaagaacgaagagacgaatggcacgaattatcgttatgatatttctgcatttcgggtatacaaaatgccgctgtttgcataactaagtatgttatgcggccggttatcgaccgcataacattatggcttatttgctaatatcatccacgcgcatggtgtggtcaggttgaatattgttaacctgcttcatatagttaaccaacgccggtgcggtttgtatccctatatatttgatatttttacctttagtgaaggtaaatccgccaccacctttaccgataaaggaatccagcgcgacggtatagagtttattgtcttctaccggtttgcctttgatatcaaattcaacaatacgctggcccagcggtttggtactgtcatatttaaactggacggttttagatacgtgcagcataccgtttttcagatcggcagcgtgtgacatgatggatttcaggtccttaccgctgatttccatgctcatgacatcgttggtgaacggatacatactcagcacatcaccataggtgatattacctttaggcaattcggtacggatgccgccagcattatagaaggaagcgtcggcgccaggaacggtagccatcagggcatcggtgattaagttgccggttggcgcggattcaccgtaagaacgggtcagcacttccggagagtgcgcgaccacttcatcggtaattttcttaaccttgttatcccattcgtcaattttggcctgcgtgaccggatctggcttataagtatccgcatacatggtgatcaacttaccattgtagctgtccacttttttggtttccgggttccagtcaagcaccagtttacctaattcgatggtgtacgcatccgtggaaacgacaagagtatcgcccactttaatcggttctggcgtacctttatgcgcatggccggtaatcaggacgttaagtccatagccttccagcgatttcgccatatcaacgtcggttttcagtgcgcgtgcgacatcagcctcgcccgcgctggactgcatacccggcacgccttcgtgggcgagcagcacggtcaggtcaactttcccttttaactcttccagctgttttttcacataaggaatcggatcgcggcagtcaacgccttcacgcacgcctgcggcaatcgcttcatagaatgcggaaacgccgtgcataccgatgacgccgatcttgaatccatctttttccacaatggtatacggttctttaattaatggcgtatctgtgccgctgtaaaaaacattatccaacaataccgggaattgcaatttgctgagctgtttaaccagattctcatggccatggtcaaattcatggttaccgacagagacggcgtcgtaaggcatggtatttaaaatatcaataatagcctcgcctttggtcagcgtactgataaaaggtccggtgaaatagtcgccagcatcaaagaaaaagacatctttctctttcgcttttgcatctttgacaattttcgagatgggcgcaaagccgcctaccggacgtgtcttggatacataggggataatttctggggttacatgggcatgtaaatcgttcgtataataaattgtgatgtcacgcgcatcggctgaaaaggaaatggctgaagacaaaccaatgcacagcgacagtagggatatcgaaaactttttgttcatataaaccatccatttacgctacattaaagaaaaacaatgcctgtagtcgtgtcattcacgactacaaaccggggaaattaagtaatattcatcaagtttattaattattaaaacttgaagccgatcaggtaattcatacggtcgccgtagccgttataccccaatttattattgaagtaacggtaagagacggaggcggtccatcgcggcataaatttccatgtaaacgttaccgcgccgttcaggccggtcgtcccaccctgttgttcggcgtaggcatcattacgatccatttcaacttcgttccagtttgaaatgacgaacttttcattaaacatatcgaagttataagccgcgacccaaccgagaacataaccgttaaagcctgtcgcctgtccatactttttagaggtataatcgttcgataagttatgaacagcgaaatagggcttaataaagcctgatgggctggttaaacccagataacctaccccgtacatcatgtttaattcatcaccgaatttattctccatcgacatatagagtttcatcattgcggtaaagttagagccttctactaccctataatgtcccagaaattgggtaacatggttacggccttctaccggatggttgagcacgttcatttcataaaatgatgcaaattcgcccctgtcaaacacggcgccgaaatcggctaccgctttccacacttcgccgcgatcgacattgacaaagcctttattccagtcgccatatccgaagctaagtttaccgtatacgcgtttcaattccgctgcctggccattaaagcaagagaaaagaacacatgcggcgagtagactattaatatatttcttatttttcatgctcaactccatgaggtaaaaacacagtgaaatgttgtgtaaagaagcgaattctaaggagtgtctttttatacgtaggtgatagatgtctcaaaaatatcagcgacatataatcgtcaaatattcgtgtcagataatgttgtttattacgtgataactatttgatttatagtttatgtctctgttgtaaaagtcacaccggatagcatgaaattaatgaaacttcgaatgggaataatctctcgcaaagacaacttactgccattaaatgagggtgttaccgttcaaacagcaacatatattgacatcacaatagcggttctgacatatgggccatatttgagatctgcatcactcgttcgcgatttctttttttatagactgcttcaggcgtgttttctttagcacgaaatatatttatggtattaatattataatgagtgtgaataatttctacgataaaacgatgttaatggaagaaatataagataaatcgaatatatatagtgcaattaatttaggctgtattccgcagccgggtctatcggcaaatatatcgtaatcagaccgtgcgataactcaaaggagttgaaatgaaaagaacagtcgttgccagtatgatagggttggcgctatgcgctggatgcgtattatcaaccgcgcaagcggcaaccgcaaagcgtcctaacttagtcattattctggcggatgatttagggtatggcgatctcgccacctacgggcaccgcatcgttaaaacacctaacatagacaaattggcgcaggagggggtgaagtttaccgactattatgcgccagcgcctctgtgttctccttcccgcgcgggcctgttaaccggtcgtatgccgttccgtaccggaatccgttcctggataccggaaggcaaagatgttgcgctggggcgtaatgaactgactatcgccaatctgctaaaacagcagggctacgatacggcgatgatggggaaattacacctgaatgcgggcggcgatcgcaccgatcagccgcaggcgaaagacatgggctttgactatacgttggttaatccggcgggatttgtcaccgatgctacgctggataacgccaaggagcgcccgcgctatggcgtggtgcatcctacggggtggattcgtaatggccaacatattggccgcgcagataagatgagcggcgagtttgtgagctctgaagtggtgaactggctggataataagaaagacgataatccgttcttcttatatgtcgcctttaccgaagtccatagcccgctggcgtcgccgaaaaaataccttgatatgtattcgcagtacatgaccgactaccagaagcagcatccggatctgttctacggcgactgggcagacaaaccgtggcgcggcaccggcgaatattacgccaatatcagctacatggatgagcaggtcggtaaagtgctggataaaattaaggcgatgggcgaggaagataacaccatcgtcatctttaccagcgacaacggccctgtcacgcgcgaagcgcgtaaggtatacgagctgaaactggccggggaaaccgacggtctgcgcgggcgtaaagacaacctgtgggaaggcggcattcgcgtaccggcaatcatcaaatacggcaagcacattccacaggggatggtaacggacacgccggtatatggtcttgactggttgccgacgctggccaacatgatggactttaaactcccgaccgatcgtacctacgacggtcagtctttagttccgctcctgaaggacaagacgttaaaacgccagaaaccgctgatcttcggtatcgatatgccgttccaggacgatccgacggatgagtgggcgatccgcgacggcgactggaagatgatcatcgatcgccagaataaacctaaatatctctataacctgaaaaccgatcgtttcgagacgctcaatcaaattggtaaacagccgcagattgagaaacagctttacggtaagttcctgaagtataaaaaggatattgataacgattcgctgatgaaagcccgtggcgataagccgacgcctgtcacctggggctaatggaataattataaaaaattaagtatgccacttagggcgatgcccacctgatccggtcactctgtgccggatcaggttcttttatttcagggaaggtaatgatgtttgggaaaagttgtcaggtcatggttaaaccaaccggatcggtgtgtaaccttgactgtaagtactgtttttatctggagaaagaaaagctctatccggatcgaaaaaaccattacaaaatgtcggaagagaccctcgaactcttcatcaggcagcagattgccgcacaggatattgatgaggtcatttttgcgtggcagggcggggaacccacattaatgggcatcccgttttatcgtaaagccgttgaatttcagcagcgctattgtggcggcaaaaccatcgtcaataccttccagaccaacggcatcctgatcaacgatgactgggcgaccttcttccgggagcatgattttctggttggcgtctctattgatggcgatgccgcgttacacgatgaatggcgagtgacgcgctccggaaagccgacgcatgaaaaagtagaaaatgcggtgcgttgtctggcgcagcacgacgtagaatttaataccctcacggtggttaaccgtaccaatatgcatcatcctgttcaggtctatcgctacctgaaaagcgttggtagccgctatatgcaatttatccctttagttgaacgctgtggggaaaatgggctggcgcagccgcaggataaacatatcgcgatgacgccgtggtcggtcgatagcctgcaatttggtcagtttctgaatgcggtatttgatatctggatccgtgaggatatcggcgatatcggcatccagctatttgaacagacgctggcggcctggtgcggcctgccgccgcaggtttgcgtttttgctcccacctgcggcagcgcgtttgcgatggaaatgaacggcgatgtttataactgcgatcacttcgtatatccgcaatttaaactggggaatatccaccagaagacgctgcgtcaaatgaatcagggcgaacaaaatcgccagttcggcagcgataaacagcgttcaatggcgcaggagtgtcatcgctgtcaatggaagttcgcctgctatggcggctgtccgaaacatcgttttttaccctctgcgtcaggcgcaaccaatcataactatctgtgtgcaggttatcaggcttttttctcgcataccgcgacggcgatgagtgccatgcgaaccctgtatgaaaaaggcatctcacttgcagaaataaagtcaatatttgtttgaaggtagtattcgcagggagtgaatatgttttctcacattaatgtcgatgcttgcaaaacgccaggctgcaaaaatctggggattctggggagcccagactatctaccgcaagggaaaaatgttctctgtcgagcgtgcggttttttgttccccattatctcagccagatcgcttaatctttttcgccaggcggcgaatcaaccctggaaaggtctggtgaagtcctgtccgcattgtggcgggacgtcgctgaaaaatatggattttccactaaaggtgaacggcgtatgtattgccgccagtgtaataaaacgttcatctcctataccgctatcaggagcgacgccagacaagagaaccttgccacgttgattggcgaaggagcgtcgctagttgaaatacgcgcggcgctggcgatagacagcacgggttttagccgcgaattacaaaaactgtcccgtcgcgctaatcaagcggaacgcgattttgtgtttcccgcgtttgatatcgctatgagcacgcgggcgtttcgtgtgaaatttaacggcggcgacagcagcttatatgtgctggtgacggcggaagaggagagcggtaaggtcgttgcgatctcaacgaattactccgcccaaccggtggaagcggattatcaatatcattctgattacgaagaacgacttccgtccggcacgctggcgcatctggtgcagcgaaaagaggcgctgaccatgcgccgcaatgtattatttgatgtggattacggccccgccattttatataaaaacgatccggggatgttagtaaaacccgtattacctgcttatcgacattttgagttggttcaggcgttgacggatgagcgctccctgaatgtccagcattatctcgatcacgaatgctttattctgggcggctgtatgatggcgaattttagctatcttcgtcaggggcgctgccatatttcgtttgtgcgtgaaagaggcgttacgccgcccaaacgcgatctccctccgcggttgtttttgagcggcggaattcgcaacaacgtctggcgtacattttccacacgggattatgcgatggcagtatgcaatctcacaggaaataaaaaggtgagtttgttacgtcatgcgacgttaaatagcgcgacggcgtttattcgctatgttcacaaccatcccttcctgccgcatcttaaccggatgtctcctggcaatgttgttgccgtactggattacctaaaatttgaatatgacgcttcatgtaactgaattgctaaaataaaaagtgtgatgaggtgttgttgcggtattttattcggacggcttaaaaatccagagtattaattttcgtggtccccatgaggggcgatgagattaatacactggagatttatcatgaatacgttaactgcaacgtctgttgtccttcctgcgccgcgtccggcgattaatcagggtatcgatatcaataatgaaatagtgcttaaccataccgctatttatgaaaattgccttgcgcaggtcacgcaagagaatacggtagaaaatgcgctcatgttgttagacccttacggcacggcacctttaagcgcctatgccggcgtctggagtctggaaccggctgagatcatggtcacggtccaggatgcggcaaaaacggcgatgccggtagaacatctttacacccttacggcaggcgcaaatctgttgccggttctggggctggtagcggagactgaaaaccgtattgtcttttctcaggcagatacgccgcttgccgtctatacgctcaccacacagccgttaccgccggtagattccgcggaggtcgtattaggttttccgattatcaacgtgacgcaacctgctaccgatgtggacaagatggcgccagggttttattttgttacgcatttcgatcgctataattacgcattagatcagaatggtctggtgcgctggtacgttactcaggattatccgtcttataattttgttcgaattgataatggccatttcctcaccacttcagaagcgaaaaatacctatctggatatgtatgagttcgacatgatggggcgtcttcacacattctataatctcgataaccaatttcaccattctatctggccgtgggacagtaataccattgttgcgccctctgaatatacctcgggtcggcccgacgatttgaaaaccaatgaagacggcgtatcggttgtcgatctggctaccggactggagacggcttactacgatatggcgaaggtgttggatacgacgcgggtttcccgtccttcaggtacggcgccgggagaagacccgacggttaaagactggctgcacataaaccagagctacgtgaatgagacgaatcagttgttaattgcgtccgggcgtcatcagagcgcggtgtttggcgtcgatctgcaaacgcaagcgttacgctttattttgtcaacgcatgaagactgggacgacgcttatcagccttatcttttaaccccggtcgacagtgaaggtgtggcgctttatgactttagcaaacaggaggatatcgacgcggccgaccgtgacttttggacgtggggccagcataacgtcgttgaaatcgccaataatacgccgggtatagtggagtttatggtatttgataacggtaactaccgttcgcgtgatgacagcaaaagcctgttaccgccggataactacagccgcattgtccatttcgtggtgaatatgaatgagatgaccgttatgcggccatttgaatacggcaaggagctgggcgcgcgtggctacagtagctgcgttagcgcgaaagcgatccagcagaatggcaatattgtggtgcattttgccgactgcacgtttgatgaaaatggccgcgccatctcttgccagcctggcgagagcgatattatcgatccgcaggcgggcagcgaggcgatggggctgctaattttacaggagattgcgcctacggagaaaaccgtgctttttgaagcgactatgacgtcaggttactacaaaaacgcggaaacgaacggggaaggctatcgctacgatattaccagtttccgggtgtataaaatggatctgtacgcgtagcggtctatcatcaatgactgactgcactaaaaaagtccggcgtaagtcggacttcatttcgtaaaaaacgagctattcatcatatataatctaattttaacgatgagtcaggcgaggtaagatagtagatccgaagaattcacctgattgagagaataaaaagtgaaacatctgcaccgattttttagcagcgatgcctctgggggcatcattctcatcatcgccgctgcgctggctatgctgatggccaatatgggcgcgaccagtggatggtatcatgattttctggagacgccggttcagctacgggttggggcgcttgagatcaacaaaaacatgctgttgtggatcaacgatgcgctgatggccgtgtttttcctgttgattggcctggaagttaagcgcgaactgatgcaaggctcgttagccagtctgcgccaggccgcttttccggtgattgccgccatcggcgggatgattgtaccagcattgctctatctggcctttaactactccgatccggtcactcgtgagggctgggctattcctgccgcgacggatatcgcctttgcgctgggcgtgctggcgctgttaggcagccgggttccgctggcgctgaaaattttcctgatggcgctggcgatcatcgatgacctcggcgccatcattattatcgcactgttttataccagcgatctttctatcgtctcgctgggcgtggcggcgttcgcgattgccgtgctggcgctgctgaacctgtgcggcgtcaggcggacaggggtatatattctggtcggggcagtgctgtggacggcggtactgaagtccggcgttcacgcgacgctggcaggcgtcattgtcggcttctttattccgctgaaagaaaaacacggacgctcgccggccaagcgtctggagcatgttctgcacccgtgggtcgcatacctgatcctgccgctcttcgcttttgcgaatgccggcgtttctcttcagggcgtcacgatggacggtctgacctccatgctgccgttgggaattattgctggtctgctgattggtaagccgctggggattagcctgttttgctggctggcgctgcgtttcaagctggcgcatctgccgcaggggaccacttatcagcaaatcatggcggtcggcattttgtgtggcattggctttacgatgtccatctttatcgccagcctggcatttggcaatatcgatccggaacttattaactgggcgaaattgggcattttgattggttcattgctctccgcagtggtggggtatagctggttgcgcgcgcgtttgaacgcgccggcataaccagtacgaagggaagggggagcgatgtatcgctcccttacgacattgagcagggagagaaatgagcatgtctcatattaactacaaccatctttattatttctggcatgtctataaagaaggttctgtcgtgggcgccgcagaggcgctttttctgacgccgcaaaccattactggtcaaattaaagccctggaagagcgtttacaggggaagctatttaaacgtaagggacgcggtcttgaacccagcgaactgggcgagctggtttttcgctatgcggacaaaatgtttacgctaagccaggagatgctggatatcgtcaattaccgcaaagaatcaaacctgttgtttgatgtcggcgtcgccgatgctttatccaagcgtctggtcagcagcgttctggatgcggcggtggtggtggacgaacccatacatctgcgttgcttcgagtccacgcacgaaatgttgctcgaacagctcagccagcacaagctggatatgattatctccgactgcccgatagattccacgcagcaggaggggctattctcagtcaaaatcggcgaatgcagcgtcagtttctggtgtacgaatccgcttcctgaaaaagcgtttcctgcctgcctggaagagcgacggttgctggtgccgggacgtcgctcaatgctggggcgtaagttgttgaactggtttaattcgcaggggttgcaggttgagatcctcggtgaatttgatgacgcggccttaatgaaggcgtttggcgcgacgcatgatgcgatttttgtggcgccgagcctttattcgctggatttttatgccgatgagtcggtaatagagattgggcgcgtggagaatgtcatggaagaatatcatgcgatttttgccgagagaatgatccagcatccggcggtgcagcgtatttgcaatgcggactactcggcattgtttaagctacagtagacatacctaccgtaatacttccggctgcggaactaacccgcagccggaatcattctacaagttcagtaggctacggtactgcccaccttcgcggataaacaccggaattctgttcagtggcgtagcgtaatgcagcgtctgccctcctgaatagctttcaccggtcgcaagatccgtccatgtttccccttctggtagccagacatcacgttcgcgcataccttcatgcatgacgggggcgatcagcaggtcaggaccaaaacagtactggtcggtgattgtccaacttgtttcctgttcggggaattcaaagaacagggggcgcatcactggcgtattgtgcttatgggtttcctccatcagcgctttgatatagggcttgagtttttctcgcaacgctaggcaacctgtcagtacgtcgcatacttcctcaccgtagctccagacctcgttcggcgcacctgtagggcactgggcgataccatcccgatacggttgcgcgggtaaaatttgcggatcgcggttgccgtgcagacgcatcaccggactaaagacgccccactggaaccagcgaatcagcaattcatggaatttcgggtcgtgaatattaccgccatggaaaccgccgatatccgtcgtccaccacggtatccctgctattcccatattgagtccggcggcaaactggttgcgcagcgatctaaacgaggagtgaatatcccctgaccagaccagagcgccgtacttctgactgccggcccaggcgcagcgtagcaggttgataacctggtcttcgccatcggctttcatgccatcaaaaaaggttttagcgtacatgcgtgggtagatattgcccacttccagtaccggtccggcatggtagcgatagttgtcgtagtcgtaaacgctgaactcaggttcggcttcatctaaccagaatagcttcacgcctttatcgtgatagttgcgtttggctttgccccagacatagtcgcgcgcgcccggatgagtcgcatcaaagtaagtggtattgccgaggaaatccatattgatcggcaagccacgttccgtttgtaccagccagccgttttcacgcatctcccgatagctttcggtgcggttatccaccgtcggccagacggagaccatcagctcaattcccagcgatttcagctcggcaatcatggcatcaggatcgggccagtcgcgcgcatcgaacatccagtcaccctgattcggccagtgaaagaagtcgataacgatcaccgagataggtagattgcggcgcttatattcgcgggcgacctccagcagctcttcctgcgtacgataacggagtttgcactgccagaagcccatggcgtagtccggcatcatcggcggcgtgccggtagccagcgcgtaagcccggccaatttctgccggggtatcgccagccgtgatccagtagtctaactgttcgctgacctgcgcttcccattcggtaacgttttgggcaaaggttacgcgtccgactgccgggttgttccataaaaatccgtagcccagactggagagcataaatggtactgaggcctgggagttacgttgcgccagctcaagcacgcatcctttgagatccaggttggcctgttgatactgccccatgccataaattttttccccttcggtggcttcgaagcgggctttcagtgaatatttcccaccctgaatcgggcggaactcgcgtccctcaaggttgagtgcgctgacgtactggccgtgagatgattcatcctcgccaatttcgccccgcaggcgccaaaactcctgcaacaggggtttgtgtggatggcggtaaaaggtaacttgtcctttttgattgacgatagcgataattttgccgttggtcagcgttgcttggtggtgctcataatcaatgtggcactggctttctgcgactggctcagtcaatgcccagtcttcatttctcattaccggcagatgacggccactgcgtacgcgcaggctgttctcgccccagggttcaatccataaatagcgatcgttttgctgccagaccagacgacgtgggtcttgttgcataaatggcatggtggtgcctcctatattcgagggtgaaggtaaagaacgttatgagttgatggtttccagatcgtggcgaatcttctcttccatcgcttcgtatttgcgaaagaaaagtaatgggatcgctgcgagcgcgaagagtagggcgggtgcccagataaaggcccaggtaattccctccagacccgcagcactctgggcatggttggggacatagccaaaactgttcatgatccaggcggctaaagcagtaccgaggccactacccatcttgatgcagaaggtactgccgaaggcgataagaatgccggtagccttaataccggtcttccaggcgccgaaatcaacggcgaagcccagcatggcaaatggcattgagcaggcgataccgctgccgatattgccgagtatccaggcggcgatgaggaaagtaatgttgtccgctgccagccacatcatgacgccgccaaacgtggcgaccagcagaccgcctacccatatccaggttttagccaggtatttgctaaagaaggggatagcgatgataaacaggatctgaatcgtcgccaggctgttaatcagcggcaccagatctttacggtcgaggttgtaggtcagataatagacaatggtcgtggagcgctgctgtagggcaatccagaagatcagattagccagcaccatcagaatccatggccagttacctttcatcgccgcgaaactttttttcatcggcaacttaggttcatgctgtattttatccgcatccatttcacgaatgtttttaaacgcaaagagcgttagcgcgcaagatataatggcaaatgtaatcgccgtataaataaaaccagcgtgatcatcaccgttacctaaaaaagcgactaacggcaaggcggtcgcgttcattaataaaaccccaatttgcccaccggtcattcgccaggaatttaaaaccagtctttccttgggagataaggtcatcaggggtaatattgcactgagtggtgtattaagtccggtaaatagaatgctggcaatcatataagatattgctgcatagatggcttttcctgttatactgatatcaggagaccaaaatgacagcgcgctgaataccgcaaaaggcagcggtaaccataaaaaccagggacgacatttaccgtagcgtgaacgcgttttatcgatgatgatcccccatataggggcgtctatgccatcgacaatacgcgccagcagcaggataatgcctgctacggcaaggctaatgcccgcaacgtctgtatagaaatataaaatgtacgttgaaccgaagcagtatagcagattacccgccacatccaaagagccgtagctaatacgctgtagtaaagacaatgatgctgacccggaaggctgggtatcctcaatgacagaactcataatgataactccgatattggtacgatacgcccagaaaaacaacctctactttctaagcaagttttgaatattatttttatgtcgtttctgaatttaacctcagattaaaatgagtaagtaaggtgtacatgaaaagtagttaacccgacggcatcaatcaattattaaatcttacatcaggattgcgtttattagtttttaaatgagcgatgtttttatttgctaaggtggtcacagttttttcagtaatgaaataagaaaaggaaaacagtgaaagaaaataactttcaagtattacgtgactaagggagggatagctgaaaaaataggctggcacaggaagagcgtgaacgagtgaggtcagcgccagcggttgacgagaaaaacggcagatagcaggcataaaaaaacccgctttacgcgggtttttctacaaagctgataacaagcaggcgattaagccagtttgttgatctgtgcagtcaggttagctttatgacgtgcagctttgtttttgtggatcagacctttagcagcctgacggtccacgatcggttgcatttcgttaaatgctttcagtgcagcagctttgtcgccagcttcgatagctgcgtatactttcttgatgaaagtacgcatcatagagcgacggcttgcgttgtgcttacgagccttttcagactgaacggcgcgcttcttagctgatttgatattagccaaggtccaactcccaaatgtgttctatatggacaattcaaaggccgaggaatatgcccttttagccttcttttgtcaatggatttgtgcaaataagcgccgtttaaattgcagcactcgttgcgtagtgatggcgcaggattctaccagcttgcgtgctgtgaatacagcctttccatgagaaaaattgcattaagcggcgggttttggggcggagtttgccgcatggcgatgaaaagcatcttctttatgtttcatcagggcaatcgccggttaaccttaaccgctgtacaaggtatactcttgcgattttcactgttttgagtcagacatgaagctgatacgcggcatacataatctcagtcaggccccgcatgggtgtgtgctgaccattggtaatttcgacggcgtacatcgggggcatcgcgctctactgcagggtttgcaggaagaaggacgcagacgcggtctgccggtggtggtcatgattttcgaaccgcagccgctggagctgttcgcaacggataaagcgcccgcccgcctgacgcgcctgcgtgaaaaactgcattacctggcgcagtgcggcgtggactatgtgctatgcgtgaaattcgatcgccgctttgccgctttgacggcgcaaacgtttatcagcgaactgctggtggagcgacttggcgtgcaatttcttgccgtcggcgatgatttccgctttggtgctagccgcgcgggcgatttcttgttattacagaaggcgggggcggagtatggttttgcggtttccagcacccaaaccttttgtgaaggcggcgtgcgtatcagtagtaccgcagtgagacaggcgctggcggaagataacctggcgcttgccgaaagtctgctgggacatccctttactatttccgggcgtgtcgttcatggcgacgagctgggacgtaccattggcttcccgacggcgaacttaccgctgcgccgtcaggtctcaccggtaaaaggggtctatgcggtggaagtcaccgggcttggcgataagccgttacccggcgtagcgaacattggcactcgtccaacggtggctggcgtgcgtcaacaactggaagtgcatctgctggacgttgtaatggacctctacggtcgccatatagatgtaatactgcgtaaaaagatacgtaatgagcagcgatttgcgtcgcttgatgagctaaaagcgcaaatcgcacgcgatgagttaacggcccgcaagttttttgggctagccgggcaggtgtaaccctgacggtgtttatcaaaccgaaatacggaaccgagaatctgatgagtgactataaatcgaccctgaatttgccggaaacagggttcccgatgcgcggcgacctcgccaagcgtgaaccgggaatgctggcgcgttggaccgatgatgatctgtacggcatcattcgtgcggccaaaaaaggcaaaaaaaccttcattctgcatgatggccctccatatgcgaatggcagcattcatattggtcactcagttaacaagattctgaaagacattatcgtgaagtccaaaggactgtcgggatttgactcgccttacgtgccgggctgggactgtcacggtctgcctatcgagctgaaagtcgagcaggagttcggtaagccgggcgagaaattcaccgccgctgaattccgcgccaagtgccgcgaatatgccgccactcaggttgacggccagcgtaaagacttcattcgtctgggcgtgttgggcgactggtcgcatccgtacctgaccatggacttcaaaaccgaagccaacatcatccgcgcgctgggcagaattatcaaaaacggtcatctgcacaaaggcgctaagccggtgcactggtgtgttgactgtcgttccgcgctggcggaagcggaagttgaatattacgacaaaacgtcgccgtctatcgacgtggcgttccgtgccgtcgatcaggatgcggtgaaagcgaagtttggtttgccgggcgtgagcggccctgtgtcgctggttatctggaccaccacgccgtggacgctgccggctaaccgcgccatctccctggcgccggactttgattatgcgctggtgcagatcgacggtcaggcggtgattctggcgaaagatctggttgaaagcgtcatacagcgtattggcgcggctgaatacaccattctcggcaccgtcaaaggcgcggagctggaactgctgcgctttacccatccgtttatgggctttgacgtgccggcgatcctcggcgatcacgtcaccctggatgctggtaccggtgccgttcacaccgcacctggccatggcccggacgactatgtgattggtcagaaatacggtctggaaacggctaacccggttgggccggacggcgcttacctgccaggcacatatccaacgcttgacggtgttaacgtcttcaaagcgaacgatatcgttattgaactgctgaaagaaaaaggcgcgctactgcatgtcgaaaaaatgcagcacagctatccgtgctgttggcgtcacaaaacgccgatcattttccgcgcgaccccgcagtggttcgtcagcatggataaagaagggcttcgtcaacagtcgctgaaagagatcaaaggcgttcagtggatcccggactggggtcaggcgcgtattgaatcaatggtcgctaaccgtcctgactggtgtatctcccgtcagcgtacctggggcgtaccgatgtcgctgttcgtgcataaagaaacgcaggagctgctgccgattgagcgtactctggcggcgatggaagaggtggcgaaacgcgttgaagttgacggtatccaggcgtggtgggatctcgacccgaaagagatcctcggcgaagatgctgatcaatatgagaaagttccggatacgttggacgtttggtttgattccggttccaccagttactccgtggttgacgcccgtccggaattcgccggtcacgctgccgatatgtatctggaagggtctgaccagcatcgcggctggtttatgtcctccctgatgattagcgtggcgatgaaaggcaaagcgccataccgccaggtactgactcacggcttcaccgtcgatggtcaggggcgcaagatgtccaagtccatcggtaacaccgtgtcgccgcaggatgtgatgaataaactgggcgcggatatcctgcgtctgtgggtggcgtctactgactataccggcgaaatggcggtctctgacgaaatcctgaaacgtgctgctgacagctatcgtcgtatccgtaataccgcgcgcttcctgctggcgaacctcaatggcttcaatccggccaccgatatggtcaaaccggaagagatggtggtgctggacaggtgggcggtgggctgcgcgaaaacggcgcagcaagagattctgaaggcatacgaagcttacgacttccatgaagtggtacagcgcctgatgcgcttctgctccgttgaaatggggtcgttctacctcgacatcatcaaagaccgccagtacaccgcgaaggccgatagcgtcgcgcgtcgtagctgccagactgcgctgtatcatatcgcagaggcgctggttcgctggatggcgccgatcatgtccttcacggctgatgaaatctggggctacctgccgggcgagcgtgaaaaatatgtcttcaccggcgaatggtacgacgggttgtttggcctggaagagaatgaagaatttaatgacgcattctgggacgatgtccgctatatcaaggaccaggtcaacaaagagctggaaaatcagaaggccaatggcatcaaatcgaacctggaagcaaaagtgacgctgaaatatgctgacgatgctaacggtacgatcaagaagctgaaactgttgggcgaagaggtcagatttatcttcattacttcccagttcgtgatttctgagcaagcggggggtattgatgatgaaaatattcagtacaatgctggtaatacgacagttcaggcagtggtaacgcgtgccgagggtgataagtgtccgcgctgctggcactacactactgatgtcggcaaggtggcggaacatgcagatatctgcggacgctgtgtcagcaacatcgccggtaatggcgaacaacgtaaatttgcctgatgagtaaaccactctgttcaacaggactacgctggctatggctggtagtagtcgtgctgattatcgatttgggcagcaaatacctgatcctccagaatttcgctctgggggatacggtagggctgttcccgtcgcttaatctgcattatgcgcgtaactacggcgcggcttttagcttcctggcggatagcggcagctggcagcgctggttctttgccgggattgcgatagggatctgcgtaattcttttggtgatgatgtatcgctcgaaagcgacgcagaagctgaataacatcgcttatgcgctcattattggcggcgcgctgggtaatttgttcgatcgtctgtggcacggcttcgttgtcgatatgatcgatttttacgtcggcgactggcatttcgcgacgttcaaccttgccgatacggcaatttgtatcggtgctgcgctgatagtactggaaggctttttgccgaagccgacagcgaaagagcaggcataagcgtaaataccgggttgcgcttatccggttttgtaggcctgataagcgcagcgccatcaggcaaacgtggtgccggatggcggtgaaaacgccttatccggcctacggttttatcgttctttgtgcctccgggcaaaacacgtgagcaatttgcatgtctaaatccgtacagagcaacagcgcgatcctcgttcacttcaccctgaaactggatgatggctcaacggcggaatctacccgcaataacggcaagccagccctgttccgtcttggcgatacctcgctttccgaaggtctggagcagcagcttctggggttgaaagaaggggaaaagaaagcgttttcgctggagcctgacgccgcgtttggcgtccccagtccggacttgatccagtatttctcgcgccgtgagtttatggcggcgggcgaaccggaagtcggggcgattatgctttttaccgcaatggatggcagcgaaatgcctggcgtgattcgcgaaatcaacggcgactcgattaccgttgattttaaccatccgctggccgggcataccgttcactttgatattgaagtgctggaaatcgatccggcgctggaggcataaacatgcagatcctgttggccaacccacgcggtttttgcgccggggtagaccgcgctatcagcattgttgaaaatgcgctcgccatttacggcgcgccaatttacgttcggcacgaagtcgtgcataaccgctatgtagtggacagcctgcgccagcgcggagcgatctttatagagcaaattagcgaagtgccggatggcgccattctgatcttctccgctcatggggtttcccaggcggtgcgtaacgaggcgaaaagccgcgatcttaccgtttttgacgccacctgcccgctggtgacgaaagtccatatggaagtggcgcgcgccagccgtcgcggtgaagaatctattctcatcggccacgccgggcacccggaagtggaaggcaccatgggccagtacagcaatccggaaggggggatgtacctggtggagtcgccagaggacgtctggacgctgaatgtcaaaaatgaaggcaagctctccttcatgacgcaaaccacgctttccgtggacgatacgtccgatgtgattgatgcgctgcgtaaacgctttccgaaaatcgtcggcccgcgcaaagacgatatttgctatgccactactaatcgtcaggaagcggtgcgggcgctggctgagcaggctgacgtagtgctggtggttggctcgaaaaactcttctaactctaaccgattggcggaactggcccaacggatgggaagaaccgcgtttcttatcgacgatgcggcggatatccaggaggcgtgggtgaaagacgccgcctgtgtcggcgtcaccgctggcgcttccgcgccggatattctggtgcagaatgttattgcgcgtctgcgggagtttggcggcggcgaagctgtcacgcttgagggtcgcgaagaaaatattgttttcgaagtaccgaaagagctgcgtgtggatgttcgtgaagtcgaataagatttcacaattcagaaatctgcccgatgatgctacgctgaccagatcttaagaatttcttttgatattcaatgtgcgacaggaaaaataaggcgtagtcgtcatccggtgctaatgccccacctttttgctattcatctgaaaaaccagcacaatcgttgctggtttttgggttgtaatgcctacagggataagggaaatgggcaaaataaaatatagattgccaacgttactcgccatcggcttttggatggacgcggcaagcgctacggtgctggagctacccgcctgggagcgaaactataccgggactatcgcggggaaaccggtaaacgttaatatcacgcgatttggtaacacgctttatgggcattactgctatgaaccttgcaatcagcacaaggcagtgattgttctacgcggctcactccaggataaagaggtgcatcttgaagaacgcgtaaaggcgctttcgggttactggaatgcggaaatctccagcagtgagattaaaggcgaatggacgtccgcagataaaaaacgacattttcctgttgcccttatctattacaaacctaaaaactcccctgatattgtgctggtcacgaacacgaatgatgcagggggttacgacccttccaaagagattgattgcggcaatacgccggccatttcggcgataaaattataccgtgatggtaaactcatacagaccttagataccgcctcggtgggcacctgtagcccgtttatgcctcaatggggggatgtcaattttgatggctacccggatctatcgattgtaacagagttacttgctgggccggatgctccagtacaaacatggctctatgaccccgccaagcagcgttatgttgatgcgcccgcgtcttatcaggagatcacttcaccagagatcgatgctgaacataaacagattgtcagctattggcgcggcggttgctgcagccatggcgtcaatgtgtatcgctggaaaggaaaaacgattgaactgatcgatcgcggtgaaagctactttcagcctgtgataagtaaaggcaaaatgtataactgctacatgacaccttcctacgctgatgggcgtattatttatccgctagtacgtaaaaatggtcatttgacgccgcctcttagccttgatgggacgtgtcaatctttttggctaaccggtaatgttcgtaccgtgattcaggcagaaaaacccggcgctgagcccgaatcgcttgagattcagtggcaggaaaacaaagcatcgccagggcgtttttgcccattagttccgtttgtcgaaggtgataagctaagtccgcgtctggtgacggatgacgatgtgcctgatacctgtatcagtcgcgctgagtatgaagatataaaacaataggtcaggagagcgttaatgacagcatccctacacattattcttgataccgatccgggcattgatgacgcggctgcgattgccgctgcgctgttcgccccccagcttgatctgcaactaataaccaccgtcgcaggcaatgtttccgttgaaaaaacgacccgtaatgcgttgcagcttctgcatttctggaacagcgatatcccacttgcccagggggccgcgacgccgctgctgcgtccgttacgcgatgcggcatacgtccacggcgaatccggtatggaaggctatgattttgtcgaccatcagcgtcaaccgttggcgaagcctgcgtttatcgctatccgggatgtgttgatgaacgccccggagcccatgacattggtggcgattgggccattgaccaatattgcgttgctactgatgcactatccggagtgtgcgtgtaacattcgccgtctggtgttgatgggcggttccgcagggcgcggcaattttacgcctaatgctgaatttaacattgctgtcgatccggaggccgcggcgctggtgttccgcagcggtctggagattgtgatgtgtgggcttgatgtcacgaatcaggcaatgctctcgccagattttctgaataaactgcctgcgctgaatcgcaccggtaagatgttgcacagcctgttcaaccattatcgcagcggtagtatgcgcactggcgtccggatgcacgatctctgtgcgatcgcctggctggtgcgtccggagctttttaccctgcaatcctgttttgtggccgtagaaacgcagggggaatataccgcaggcacgacggtcgttgatattgaagggcgtctggggcagcccgccaacgcgcaggtggcgctggcgctggatgtggacggttttcgtcagtgggtggctgaggtgtttgcctatgtgccgtaattacatgttggcgccataatctcatactttgccgcgatagagtctctccggcctgcccactttcccgtagctgatctccgcttcgagaaagttatttttcacgccttgttccagatagcgtcgggcagtggttttactgctgcccagaatttgcgccagagtgtctgctgtatgtactgcctgcgggtcggcgaatatttgtcgtacccggttgaaggtgttttcatcaattccccgcagtccgctattcggttctgcggtttgttctttggcctggatattaaataaggcatcaacgtgcgtctggtttgcctgctcactggaacgtaacgaactgcggtaacgggtgaaccgctccagggtatgctgcaggcgctgataatgtaccggcttaatcagataatcgaatacgcccatgcgtaaggcatcgctgatggtatccatatgattgtcggcggtaatgaaaataattcgccccgtgtagttggtgctgatggtatgacgaattaaatcgatccctttgccatcgggtaaaaaattatccaatagaattaactgtggttgatagaggcgtatttgcttcttcgcactttccagcttgtctgcgataccgacgattgaaaactgaggaaaaagcttgatggtgtccaccaggatttccgctagcatcggttcgtcttcaacgatgagtgtcgtaatgctatccatgttattcttctctggtaaaagggatatagagggtaaaaatggtgccaaaagaattattgttatcgacgataatgtcgccattggcctgcttgacgtagctgtgcaccaaccataatccaattccgtgatcgccgttgttgtgggtggtcactccacgctcgaaaatatgctggcggatattttcgtcaataccacatccctgatcggcaacttcaataatgacttcattaccttcgctattgatcaggcactcaatctgtcgcgagccttcgcgattgagcagggtggcgttataggcgttgtccaataaattgccaacaatcgaaatccattcattatgcgagagcgatgacggcaggtgttcaacaaagcttgaaggatcgaaaatcagctccagccccagctcttttgcccgataatatttaccgattaatagccccgcaaggtggtggtcgcggaaattatgggaaataaaatcgagtactttttggtggctttccgactgctgctgaatcagcgccagcgcattatcgtagcgcttcaggaacagcagtccggcaatggtggaaataaggttgcgatgctcatgctgcacggcgcgcaggttatcggcgtattgccgcacctgacttaactgcaggttgagtgtattgatatcgtctttgttgcgaaagctaataacccagccctgaggctggttgtcaataatgaccgccatgcgactggcgatgactttcatttggttaaaagtgacgatctcatcttttttgtttttttgcggcgcatcgtaaaagaaggcctccggcaacacgatatggtggattgcatagccaatgagttcagactccggttggctcagattcagtaagcggcgagccgtttgattaatggcggtaatacggtgatgggagtcaatggcgatcaacccttcaaataccgactcaaataacacgctttgctgaattaatagttgtgaaagctgctgcggctccatgttaagcatctgctttttaatatgcagcgagaagcggcgggcgcagtacaacagcaccagcaacagtatcgccatcgggaacagcaacgagctgatttgtaagttaagccagctctccaactgttccagagtatagccgacggaaacaataccgatgactttaccggtactgtcctgaatcggggatttaccacgcaaggaagagcctaatgaacctttgcgcaccgatacgtagcttttagcattatacagcgcgtcgtcgctatcgccgccctccatatatttgccgatctcatccgggttgacgtgatacagtcgctgacctttttcgttgccaacggtaatgtaagtcgcgtccgaaaacgagcgcattgggtcaatcagcgctttgatgcgtgacaaatcatgcgcctctacggcttcaactaattctggcatagcggatatttgcattgcttgaataagcgcacgttggcccacctgataatgcaggcgctctttcgtgatatcggtcagataccaggtgattgccagcatcacgatggtggatgtaaacaggatcagtagaaatatccggttttgaaacgagcgtctggcaaaccagtgtgtaatttcccgtataaacatattggtatttagatatttaattacggtattttcttgcattcggcatcaccggaacctgaaccagttcatacttacttttctttcagaaaaaatttggatgaaaatgggatacgacatgcgtatcccatccactattacatcgccagcacgtatttcagcatcaccccggcggctatcgccgagccaatcaccccggccacgttcgggcccatcgcgtgcatcagcaggaagttctgcgcgtctgattccaggcccactttgttcgatacgcgtgccgccatcggcactgccgacaccccggctgaacctatcagcgggttgattttgttcttactgcacaggttcagcagcttcgccatcagcaccccggccgccgtcccgataccaaaggcaatcacccccagcagcagaatgcccagcgtctgcggctgcaggaacttatccgcgaccagcttcgcgcccaccgacagcccgaggaaaatggtcacgatattaatcagaccgttctgcaccgtgtcgctcagacgctccaccaccccgctttcacgcatcagattgccgaagcagaacatccccagcagcggcgcggcgtccggcagcagcagggccaccagcagtaacagcaccaccggaaagaggattttttcccgcttactcaccgtgcgcagctgcaccatgcggattttgcgctctttctcgctggtcagcgcgcgcataatcggcggctggattaacggcaccagcgccatatacgagtaggccgccaccgcaatggcccccagcagctccggtgccagcttgcccgacagataaatcgccgtcgggccgtccgcgccgccgataatgccgatggccgccgcctgcggcagggtgaaggcaatcaggccgaagtagttcagcgtcagcgcccccagtacggtggcgaagatgccgaactgtgccgccgcccccagcagcagggtgcgcggattggccagcagcgggccgaagtcggtcatcgcgccgacgcccataaagatgaccagcggcgcgacgccggagccaatcgccactttatagaacagcgccagcacccccggcgtgtagcccatgtccaccgccagattttccatctggttctggactgacggcagggccagcgccagcgcttccttgatggcgtgcacgtccggcgcgcagttgagcttcgcggcaatcaccgccagctgcccggcgtcgtgatgggccagcaggctctccagcgcggtcagcgccatgcccgcttccgggatgttggagagcaggccgccgaagcctatcggcagcagcagtaacggttcgaactttttcgctatcgccagccacagcaacagcaggctgaccagcagcatgatggcctggcccgcgccaaggtgcatcagccccatgccctgaagcagggcgttcagactttccatttcagttctccgttacgccagcgtcatcagggtgtcgcccacggagacggcgtccccggacttcaccgcgataccgcggacggtgccggcctgcgcggcgcggatttcggtttccatcttcatggcttccagaatcagcagcacgtcgccttcggccacgctctggccttcggtggcaatcaccttccagatgttgcccgccagcggcgcggtgaccggggtgccggcgcctgccggggcggcagcctgaaccggtgcggaagaggccgccggaacagccgtagtaagctggctgatatcgccgccgtcgctgaccctcaccacaaaggctttgccttccacttccacggtgtagataccggaggcggcaggcttctctgcttttgccaccggctgcgcggcttccgcctgcggcagtggctcaaacgccgccgggttatggcggttctcaaggaatttgaggccgatttgcgggaacagcgccacggtgagcacgtcgtcgatggcgtttcccgccagagtaatccccttctcctgcgcctggcgcctgacgtccgcttccagttcagccagctccggcttcagcaggtccgccgggcggcaggtcaccggagcgctcccttccagcacgcgggcctgtaacgcggcgttaaccggcaccggggtgtggccgtattcgcctttcagaatgccggcggtttccttcgcgatggttttgtagcgttcgccggtcaggacgttgagcaccgcctgggtgccgacaatctgcgaggtcggggtgaccagcgggataaagccgaggtcctcgcgcacgcgggggattttcgccagcacctggtccagcctgtccgccgcgttctgctgcttcagctggctttcgaggttggtcagcatcccgcccggtacctgcgccaccagaatacggctgtcgtagcctttcagctggccttcaaaggcatggtactttttgcgcacctcgcggaagtacgcggcgatattttccagcttcaggatatccagcccggtgtcgtgctcagtacctgccaacgtcgccaccagcgcctcggtggccgggtggccgtaggtggcgctcatggacgaaatcgccgtgtccacgccgtcaacatccgcctcgatagccttcagcagggccatctccgccatcccggtggtggcgtgacagtgcaggtgcaggcgcacctcaaaacgttttttgatttcgctcaccagctcaaaagcggccatcggcgtgagaatgccggacatatccttgatggcaatcgagtcaacgccggtctctaacaactgttcggtcaggtccagccaggtctgcagggtgtgcgccgggctggtggtgtaggagagcgtcccctgggcgtgcgcgccgtggctgcgcaccgcctgcagggcggctttcatattgcgcgggtcgttcatggcatcgaagacgcggaacacatccatgccgtttttcaccgcgcgttcaacgaagcgctccaccacatcatcggcgtagtggcggtagccgagcaggttctggccgcgcagcagcatctgcagcggggttttgggcatggcttttttgagttcgcgcaggcgcagccacgggtcttcgccgagaaaacgaatacaggcgtcaaaggtggcgccgccccagcactccagcgagccgtagcccacgtcgtcgagctgagcggcaatcggcagcatatcgtcaaggcgcaggcgggtggcgaacagagactggtgggcgtcacgcaggacgacgtcggtaatggcaatagtcatggatccctccgggaattaagcgttaaggcggtgatggtgaatggcggcggcaatcaccggctttaagcgggtgaagtcgtccacggcgggaacggcgcgcggtgcgggcgcggcgacgggttccgggaagaagcgagtaatcacggcagacataccgcgaatggcaaagatcagcaggaacagaaagctcagtacgaaccccatccctaaaaacatcagggtgaaaccttcacccagtaatacagcttcattcatgaatcattttccataatgagaggcacgacggtggccttgacgacaaccttcctggtgaatccggctaaggagtagagtggatttcccttggccacctctggctttggcctctacttttctccaggtcgtttgcggcaaagacaccgccgtgcgtttttttacaccatcatgctgaacacgatgctagcgataaccagcacaataccgccgcccagacgagaggaaatttgtgcatatgaaatgaggttcatacggttacaggcggagagcacttccagatcgccggagccgccgcggttggccatacaaagacccgcagtaatggatgattcaatcgggtagaagccaatcaaccagcccccgatagctgcgccaacgacagcgccgaccacaatgatcgcggcgataacgacgttcgcgaacgtcagggcatcgatgatctcttgcagatcggtgtagcaaacacccacacctaccatcagcacccacagcagttgtttggagaagaagtcagaaagacgtttcgccccggctttaatctccggtgagcaaagacctgatgcgttcagcgcagcaacaatcaggaccatccaggcgaagtagtgaatagagacgccgccgatgcttggcagaattttcttggcaacaacataggccagcaggaagcaggtggtggataacaccatgccaaccgccgtttcacgatgggtaatctgaccggccttttcatcatcttcggttttgaaggaagccttacgaaccaattcaccttcaccgctaagccaggtgtattttttgcctatcatatcgaggagggcggcgaaaataatggcgaagatattcgcaatggtcagaatagcaatagccgttgagtaatactcttcgcgagaacgtccggtaaccgagtgataaatttcagacagaggcacggcgcctgcgccgttaccaccgcccataatcggcagaacgtatagcatcatgatacggtcgaccgggataccgaagcacaaaccaatgacgataccgaaaagggacgcgccgacaatcccggcgaggatggttgggatatagcccagcagtgattttaatagcagcttacggtttaccgacaggatcgcgcctgtgatcaacactgcgataaacaggttaaggaagttgcttttatccattacgttgctgatcgcatcaatttctttctgcgtaaatatgccagcatagacaaaataagctgcaaccagaaatatcataaccggtgcgccgccaatatatttattgaagatcggtaaacgtttgccgatttcaccaaaaatggcccccataacaaacataagagcaaaaccaccgactaagtcagtcggtatagcattatagaaatgagacagtaataaagtaattaatgcaaaggcataaagcggtagcggcataccaaagattttgaatctgagtaaatcgctggccccctttttctccgtcgccgaagcctgggtcatgttggtcataaacattttcctgtgtattgatgggtaacaagacccgcgcatactaataaattcaatgaaccgtgagatgtgactatcttcactgaatggttgtgtttttaattaatttaattatttttattaactctggttaattaaggaaataaaaaccataaagcttataaaagcaagggggaaagtgtgatgtctattccagacgagtaatacaaacgctggcgaaatatgcaacgttatttgctgacggatgcagaatagagtgaatctaatatttaaacgcatttatttgcaaaaggatgtattgcgtcgcgagtcggtcgccatgtttctggagggcgtgggactcgccctggaagatgattgtgaaatcgcggtatgcgcatattggcagggtgagatagttggatgcggctcgctggccggaaacgtactgaaatgcatcgccgtttccccggttttacaaggggaagggctcagcctcaaactgctgactgagctgcttacattggcctacgagttaaaccgcagcgagcttttcctgttcactaagccgcaaaatcggttgctgttttctggcgcggggttttggcccattgcgcaggcaggtgagctggcggtgttaatggagaacagcagtgaacggttagcgcgcttttgtcgccaactggcgctttatcgtcaaccgggaaaaacgatcggcgccattgtcatgaacgccaatccgtttaccttgggccaccgttatctggtggagcaagcggctgcggcctgtgactggttgcatctgtttgtagtcaaagaagatgcttcatttttttcctataccgaccgttgggcgctgatcgaacaaggaatcgcgggcattgacaacgtcacgttgcattccggctccgcttatatgatctcgcgtgcgacgtttcccggctatttcctcaaagaaaaaggggttgtggacgactgccattgccagatcgatctgcaactcttccgtgaacatctggctccagcgctggggattacccatcgttttgtcggcagtgagccgttttgtcctctgacctgtgcctataaccagcggatgcacgacattttacacgatccgaagcgcagcggcccggttattgaggtcgtcgagctggcgcgggtggagaaaaacggcacggctatttccgcctctcgcgtcagaaaactgtatagcgaacgtaattggccggcaataagcgcgctggtgcctgctggcaccctggcatatctgcagcggcatgccgccagacacactgaaaccatatgacgtaacaccgttaacaaggaacataactaatgaaaatcattaaagatgccctggcaggcacgctggaatccagcgatgtgatgatcaggattggtccatccagcgagccaggaattcggctggagctagagagtctggtgaagcagcagtttggcgcggcgattgagcaggtggttcgggaaacgctggcgaagctgggcgttgaacgcgcgctggttagcgtcgatgacaaaggcgcgctggagtgtattttacgcgcccgagtgcaggcggcggcgttacgcgctgcagaacaaacggaaattcaatggagtgcgttatgagacctcgtcgcagtatgttgtttatccccggcgcaaatgcggccatgttgagcacctcgtttgtctatggtgcggacgcggtgatgttcgacttagaagacgccgtagcattacgtgagaaagataccgcccgtcttttagtccatcacgcgcttcaacatccgttctatcaggatgttgaaaaagtggtgcgcattaatccactgaacacgccattcggtctggccgatcttgaggccgtcgtgcgtggtggcgcggatatcgtgcgtctgccgaaaaccgacagcaaaaacgatgtgctggagctggaagcgcaggttgaacggatcgaacgtgaatgtggacgtgaagtcggcagtaccaggctgatggcggcgatcgaatcagcgaaaggcgtggtcaatgccgtcgacatcgccacctccagcccgcgcatggtggcaattgcgctggcggcatttgattacgtgatggatatgggcaccagccggggcgatggcaccgagctgttctacgcccgctgcgcagtgctgcatgcggcgcgcgttgcgggtattgccgcctatgatgtcgtttggtcggatatcaataatgaagaaggcttcctgaaggaagtgcagttggcgaaagggcttggttttaacggtaagtccttagtgaatccacgtcagattgagctgttacatcaggcttattctccgacgcgtaaagaagttgagcatgcgcacgaggtgattgccgccgctgaagaggctgagtctcgcggtctgggcgtcgtttcactcaacggcaaaatgattgacggcccgattatcgaccacgcgcgcaaagtggtggcgctgtcggcttccggtattcgtgattaaggaaggaaccatgaaagagactgtaactatgctcaatcagcaatatgtcgtaccggaaggattacaaccctaccagggggtaacagtgaatagcccgtggcttgccagtgaaacggaaaagcgtcggcgtaaaatttgtgactcgcttgaagaggctatccgtcgttccgggcttaaaaatggcatgacgatatccttccaccatgcgtttcgtggtggcgacaaagttgtcaatatggtgatggcgaaactggcggaaatgggattccgcgatctgacgcttgcctccagctcgttaatcgatgcccactggccgcttatcgaacacattaaaaatggcgtggtgcggcagatttacacctctgggctgcgcggcaagttaggggaagagatctccgctggcctgatggaaaacccggtacagatccactctcacggcggccgcgtaaaactgattcagagcggtgagctgaatattgatgtcgctttcctcggcgtgccgtgctgcgacgaatttggtaatgcgaacggttttagcggcaagtcacgctgcggctctttggggtatgcgcaggttgatgcgcagtacgctaaatgtgtggtgctcctgactgaagagtgggtcgagttccccaattatccggccagtatcgcgcaggatcaggttgatttgatcgtacaggtggacgaagtaggggatccggaaaaaatcactgcgggcgcgattcgtctgtccagcaacccgcgtgaactgttgatcgcccggcaggcggccaatgtgatcgaacactcgggttatttttgtgacggtttctcgctgcaaaccggcaccggtggcgcttctctggcggtcacccgtttcctggaagacaaaatgcgtcgccacaacattacggcgagttttggcctgggcgggatcaccggcaccatggtggatctgcatgagaaagggttgatcaaagcgctgctggatacgcaatcattcgatggcgatgcagcccgttcgctggcgcagaacccgcatcatattgaaatttcaaccaatcaatacgcgaaccccggctctaaaggcgcggcatgcgaacgcctgaatgtggtgatgctgagcgcgctggaaattgacgtgaatttcaacgttaacgtgatgaccggttcaaacggcgtactgtgtggcgcatcgggcggccatagcgatacggcagcaggggccgatctcaccattattaccgcaccgctggtgcgcgggcgtattccttgcgtggtagaaaaagtgctgactaccgtcacgctaggggcaagcgttgatgtgctggttaccgaccatggtattgcggtgaaccctgcgcgtcaggatctgcttgataacctgcgtgctgcgggcgtggcgctgatgaccatcgaacaactgcaacagcgcgccgagcaactgaccggtaaaccgcagccgattgagtttaccgatcgggtggtggctgtggtgcgttatcgcgacggttcagtgattgacgtgattcgccaggttaaaggctgatgaagggcacagacctgctgtaccagggccaggcagttacgctggaggagatgctacaagcgcgcgataaacgtgccgccaggcagcgtcaggcgttgaactgctatcggctaccgttgatttccctcacgctggttgcaccgggcgccgttaaaaactcagcggtctggcggcgtgtcgccgattacgcaattgccgaaatactggcgctttgcgaacagaaggagtgggtcaacgtctgggaaatgcaggtaaatgaacgcagcggcccggaatggatggcagcggtctgtgcgccggcaatggcgttgaaacagcacatgtcgacactagagatgagccatccgttagggcggctttgggacatcgacattattgatagcgacggtaagtcgctatcacgccgtgaactcgggcatcctgcccggccatgtttgatatgccagcaggatgctcatctctgtgcccggggcaagcatcacacccttgaccttttgttggatgaaattgcacgaaggattgaatgctatgaacgtgagcgttgtgactgaacggcgtacgccagcgtactcatcgctggcggctggcgaacttaatgggttggttgcaagagcgctgctgacggaagccaggctgacaccaaaacccggtctggtcgatattcgtaattcgggagcgcatagggatatggatctggcggcatttgaacgtagcactaccgccattgctccgtggatggaaaagttttttatcatgggcaacaacacggcggcgctggcggcagaaaatgtcctggtgatgctgcgtccgctggggatggcctgtgagaacgatatgctacaggcgaccaatggtgtgaatacccatcgcggggcgattttcgcttttggcctgctgagcgcagcgattggccgacttctcgcgcggggagaaccgttggagcaaaatcgtatctgcgaccaggttgctcgcctgagtcggaatattgttgcccacgagctctcagcaagaaaagcgggaaaactgacaaagagtgaaacccatttccagtgttatggcctgtcgggcgcgcggggagaagcggaaagcggttttcgaaccgtcagaacgcaggctttgccggtgtttaaccgggtcgtgcaggagcatgacgatacccatcttgccctgctgcaaacattgttgcatctgatggcgtggaatgatgataccaatctggtgtcacggggaggcctggaagggctttactacgtgcagcagcaggcacaaaaattgttgtggcaagggggcgtattggttgaggggggcattgaagcgatgcagttcctcgatgatgaactcatcctgcgtaacttaagccctggcggtagcgcggatttactggcagtgacctggtttttaagtcattttcctgccggttccctctatcctgagtaagtttctcttctttcattctctccagcaatgattcatcctgtgggatgaatcatgtcttttactgatatcgctccctgtttatcattaatttctaattatcggcgattttagatggcggcctccgggcgcgctggttactctgaaaacggtttacgcaatttttacaaaagagaatagctatgcatgaagcacaaatccgcgtcgccattgccggcgccggtggccgcatgggacggcagttaatccaggccgccatggcgatggaaggtgttcagctgggtgccgcgctggagcgcgaaggctcttccttgctgggcagcgatgctggcgaactggcgggggcgggaaagtccggcgtgatcgttcaaagcagccttgaggcggtaaaagatgattttgacgttttcatcgattttacccgtccggaaggcacgttgacgcatctggcgttttgccgccagcatggtaaagggatggtgattggtactaccggctttgacgacgccggtaaacaggccattcgtgaggcgtcgcaagagattgcgatcgttttcgccgcaaactttagcgtcggcgttaacgtcatgctcaagctgctggagaaagccgcgaaggtaatgggcgactatagcgatattgaaattattgaagcgcaccaccgccataaagtggatgcaccgtcggggacagcgctggcaatgggcgaggcaatcgccggggcgctggataaagatctgaaggactgcgcggtctactcgcgtgaaggttataccggcgagcgcgtaccgggaacgattggctttgcaaccgttcgggcgggcgacatcgtcggcgaacataccgcgatgtttgccgatattggcgagcgcgtagagattacgcataaagcttccagccgcatgacgtttgcaaatggcgcgttgcgatcggcgttatggctaaaaacgaagaaaaatgggctatttgacatgcgggatgtgctggggctggatgtattatagcgactaaataccttcgtgatgtggttgtggtaatcaagattaattgattacaaagggcaatatattattgcccttttgtttttgcccctcggttattcggtcagataaataacgcctttcaccattcatgtttcgacagtttcttctcccacgacatgttctgccgcagtggcttaccgtatgcaaaaggcacctcgaccagactgataagactgatatccattggggggttagtgctgttccacgggatcgttttatctcttttgcttcaataagttagcttttttatgctgtagtgaggctgtttgtggtccaatcgtatgcgcctgtcttaaagaaaaagaagttagatattaatatcgaaattggagttatcattatatagtcttaatttgctgttttttgttgattttatgatgcatttgatttgttttttatatttttaaggtattgatttttaaaatgtttttgttgttaatttgatttattttgaatttttatgcatttaatgactattaaatgaatttttatcgttgttttttgttgttttaatgtgaaatttgaccatttggtccactttttatcatggcagccagttttttgcgaactcaaggaagcgcaagcgttttctatcgtcacttagttgatctttttgcctattaaacagaataacttccttataatgtgcaaaataacataaaaaatacccgctttaagttgacttttatccggcttaacttcagaatgccgccgtttgccagaaatccacgggtaagcaaatttgcattgcttcatactgactgaatgaattgatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattcccgccaaatcgtcactcttacttatccccatattggtaatgtcggcaccaatgaagccgatgaagaatcttctcaggttcatgcgcaaggtttagtgattcgcgatctgccgttgattgccagcaacttccgtaacaccgaagacctctcttcttacctgaaacgccataacatcgtggcgattgccgatatcgatacccgcaagctgacccgactgctgcgtgagaaaggcgcacagaacggctgcatcattgcaggcgatagcccggatgcgaagctggcgctggaaaaagcgaaagcatttcctggactgaacggtatggatctggcgaaagaagtgaccacggcggaaacttaccgctggacgcagggtagctggacgctgaaagacggtttaccggaagcgaaatctgaggatgacctgccgttccacgtggtggcctacgattttggcgccaagcgcaacattctacgtatgctggtggatcgcggctgccgcctgacggtggtgccagcgcaaacctctgctgaagaggtgctgaaaatgaatccggacggcatcttcctgtcgaacggccctggcgacccggcgccgtgcgactacgccatcgaggcgattaagaaattcctccagaccgacattcctgtgttcggcatctgcctcggccatcaactgctggcgctggcgagcggtgcgaagaccgttaagatgaagttcggccatcacggcggcaaccatccggtaaaagatatggacagaaacgtggtgatgatcaccgcgcagaaccacggatttgcggtggatgaagactcgctgcccgccaacctgcgcgtgacccacaagtcgctgttcgacggcaccctgcagggcattcaccgtaccgacaaaccggcgttcagcttccagggacacccggaggcgagcccgggcccgcacgatgcggcgccgctgttcgaccactttatcgaattgattaagcactaccgttcttcagcaaaataatcaggagccaacaaaatgccaaaacgtacagatataaaaagcatcctgattctgggcgcgggcccgattgttatcggtcaggcgtgtgagtttgactactccggcgctcaggcgtgtaaagcgctgcgcgaagaaggctaccgcgttattctggtgaactctaacccggccaccatcatgaccgacccggaaatggccgatgccacctacatcgagccgattcactgggaagtggtgcgcaaaatcatcgaaaaagagcgtccggatgcggtgctgccgaccatgggcggccagaccgcgctgaactgcgcgctggagttggagcggcagggcgtgctcgaagagttcggcgtcaccatgattggcgccaccgccgacgccattgataaagccgaagaccgtcgtcgcttcgatatcgccatgaagaaaattggtctcgacaccgcgcgttccggtatcgcgcacaccatggaagaagcgctggcggttgccgctgacgtgggcttcccgtgcatcatccggcctagctttaccatgggcggcaccggcggcggtatcgcttacaaccgtgaagagttcgaagaaatctgcgaacgcggtctggatctctcgccaaccaacgaattgctgattgatgaatcgctgatcggctggaaagagtacgagatggaagtggtgcgtgataaaaacgacaactgcatcatcgtctgctctatcgaaaatttcgatgcgatgggtatccatactggggactcgatcaccgtggcgcccgcccagactctgaccgacaaagaatatcaaatcatgcgtaacgcctcgatggcggtactgcgtgaaatcggcgtcgaaaccggcggttctaacgtccagttcgcagtgaacccgaaaaacggtcgtctgatcgttatcgaaatgaacccgcgcgtctcccgctcctcggcgctggcgtcgaaagccaccggtttcccgattgccaaagtggccgccaaactggcggtaggttacacccttgacgaactgatgaacgacatcaccggcgggcgtactccggcctccttcgagccgtccatcgactacgttgtgaccaaaattccgcgctttaacttcgagaaattcgccggtgccaacgaccgtctgaccacccagatgaaatcggtcggagaagtgatggcgattggccgcacgcagcaggaatccctgcaaaaagcgctgcgcggcctggaagtcggcgccaccggcttcgacccgaaagtcagcctcgacgacccggaagcgctgaccaaaatccgccgcgagctgaaagatgcgggcgcagatcgtatctggtatatcgccgatgccttccgcgcaggcctctccgtcgacggcgtgttcaacctgaccaacatcgaccgctggttcctggtgcaaattgaagagctggtgcgtctggaagagaaagtaactgaagtcgggattactggcctcaacgccgacttcctgcgtcagctcaagcgtaaaggttttgccgatgcgcgtctggcaaaattggcgggcgtgcgcgagggggaaatccgtaagctgcgcgaccagtatgacctgcacccggtctacaagcgtgtggatacctgcgcggcggaattcgccaccgacaccgcctatatgtactccacttatgaagatgagtgcgaagcgaacccgtccgttgaccgcgataaaatcatggtcctcggcggcggcccgaaccgtatcggccagggcattgagtttgactactgctgcgtacacgcctcgctggcgctgcgcgaagacggttacgagaccatcatggtcaactgtaacccggaaaccgtctctaccgactacgacacttccgaccgcctgtacttcgagccggtgacgctggaagacgtgctggaaatcgtgcgtatcgagaagccgaaaggcgttatcgtgcagtacggcggccagaccccgctaaagctggcgcgcgcgctggaagcggcaggcgtgccggttatcggcaccagcccggacgccatcgaccgcgcggaagaccgcgagcgcttccagcacgcggttgaccgtctgaagctgaagcaaccggccaacgccaccgtcaccgccattgaacaggctgtcgaaaaagcgaaagagatcggctacccgctggtggtgcgtccttcttacgtgctgggcggccgggcgatggaaattgtctatgacgaagccgatctgcgtcgctacttccagacggcggtcagcgtctctaacgatgcgccggtgctgctggatcgcttccttgatgacgcggttgaagtggacgtggacgctatctgcgacggcgaaatggtgctgattggcggtatcatggagcacatcgagcaggcgggcgtacactccggcgactccgcctgttctctgccggcctacacgctaagccaggaaattcaggatgtgatgcgccagcaggtgcagaagctggccttcgagttgcaggtgcgcggcctgatgaacgtgcagtttgcggtgaaagacaacgaagtctacctgattgaagtcaacccgcgtgcggcgcgtactgtgccgttcgtctccaaagccaccggcgtgccgctggcgaaagtggcggcgcgcgtgatggccggcaaatcgctgaccgagcagggcgtgactcaagaaattatcccgccgtactactcggtgaaagaagtggtactgccgttcaacaaattcccgggcgttgacccgctgttagggccagaaatgcgctccaccggggaagtgatgggcgtgggccgtaccttcgcggaagcgttcgccaaggcacagctgggcagtaactccactatgaagaaacagggccgtgcgttgctctcggttcgcgaaggcgacaaagagcgcgtggtggacctggccgctaagctgctgaaacaaggcttcgagctggatgccacccacggtacggcgattgtgctgggcgaagccggtatcaacccgcgtctggtgaacaaggtgcacgaaggtcgtccgcacattcaggaccgcatcaagaatggcgaatatacctacatcatcaacaccaccgcaggccgccgggcgattgaagactcaagggtgattcgccgcagcgcgttgcagtataaggtgcattatgacaccacgctgaacggcggttttgccacgacgatggcgctcaatgccgatgccaccgagaaggtaacctcggtgcaggaaatgcacgcgcagatcaaaaagtcgtaaaccaagggggcggcggatattgctctaaccgaacctgtaatataatgttgaaagggtttctgtaaagaaaccctttttttatcttgcgtaaggtcattcctggagaagtccgtttccgtaaccacattttcaatgtaataagcacgatattgctcacactaatcaatatttaagtcgcatactatctttcatatccacaattttaatatggcttagtttttattagtttggacaggccgtagccagatttttaatttgtgaaatggtgtgcttatgtgtgaaaaatatgttgaaagaccgctttatttgttaattgctgactggatgatggcagagaaccgatggatcactgccagggagatttcccgtcaatttgatattgaacattgcaaagcaattaatacgctctcctatattctgtcagaagtgggggaaattgtttgtgaagtgaagatgatccctaaccaaattgcaggacgaggctgccagtgccagcgtctggtgaaagtcgtgagtatcgactctcaactctatcgccgattgaatcataatttgcaggaaagaaaagtgagcgtggcgaaagcgccgcggctgtctgccgttccccccacagagctaaaccgtgagcagaaatggcagatgatgctctccaagagtatgcgtcgctaattgtctgtttaacctgctggcggggtaaacggtaattgacgcgtaggccggataagcgtgagcgcatccggcatcaattactgtgctgattttggcttcacgtccgtcgtgcctttcaggcgcggtcggttttcttcgacctgcgttaacggcttcgtttcagataaccccgttcgacaacggatcgcaagatcctgatattctttggtattgaggcgtttccagtgcagctcctggtccgtaacctggcgtagtacgcgcgccggtgatcccaccagcagttgccttgcctcaccctgaaatccggctttgacaaaactcatggcggcgacaatgctctcttcgccaatcactgcgccgtccataatgacgctattcatgccgaccagggcatcccgtcccaccacgcagccatgtagaatagcgccgtggccgatatggccgttttcatgcacgatggtatcggtatcgcagtagccatgcataatgcagccatcctgcagattagagcctgcctccaggatcaggcgaccataatccccacgcaatgacgcgagtgggccaatataaacaccggcgcccacgatgacatcgccaatcagcacggcgctgggatggacaaacgcgtccggatgcaccaccgggatcagtccttcaaaggcgtaatagctcatggttgtacctcggtttttttttgtcggatggcggcgtaaataccttatccggcctacggttgtgcatgtgttgtaggccggataagcaaagcgccatccggcatagtcacattaacgacctttccacaccggagcgcgtttttcggcaaatgcctgcggtccttcgagcgcatcttctgaatgcagtaccgacggataatgtttcagcacgccgctgcggatgtagcggtagccttcttcaaccggcatttcactggtcgcgcgataaatctctttcagcgccgcgatagccagcggagcgctattgaccagttgttgcgccagttcgcgcgcgctctccatcagttcgctctggctgacaacgcggttcacgatcccccaacgcagcgcttcttcggcgctcattcgtctgccggtcattaccatttcgttgacgatagccggtggcagcagcttaggcagacgcaatacgccgccgctgtcaggcacgatgccgagcttggcttccggcagcgcgaagctggcgttttcggcgcagacaataaagtctgccgccagcgccagctcaaaaccgccaccaaatgcgtagccgttcaccgcggcgataaccggcttatcgaggtcaaatatttcggttaaaccggcaaagccgccgggaccaaaatcggcatccggcgcttcaccttccgctgccgcttttaagtcccagcccgcagaaaagaatttctccccgccgccggtaatgattgctacgcgtaattccgggtcgtcacggaaattaagaaaagcttcacccatcgcaaaactggttttcgcatcaatggcattcgctttaggtcggtcgagggtaatttccaggatcgggccgttacgggtcagatgtaatgactcactcatagttcatctccagataaatagtttcccggcgggagggattcctgccggaaggtttatttcagattttttttgattatttttcctgaacagttgcgtggcaggtcagttctgatctccataaaagagggaactttgaatttcgccatattgttttcgcagaagctgaaaaactcggcctcgcttaatgtttcaccttcattaaggacgataaacgctttaatggcttcatcacggatcgcgtctttaataccgaccaccacaatgtcctgaattttcggatgcgcagaaataatattttccagctcgacgcaggagacattttccccgccgcgtttaatcatgttgcagcgtctgtcgacaaaatagaaatagccatcctcatcctggtaacccgaatcaccggtatgtaaccagccctctggttccagcgccctggcggttgcctccggctgcatgtaatactctttgaagatagtcttgccggggatgcctttaatacagatttcgccaatttctccggcgggcagcgggcgattttgatcgtcgcgaatttcagcttcatagctaaagcccacgcgaccaatggaaggccagcgtcgtttgtctccgggacggtcgccaataattccgacaatggtttcagtcataccataagaggtcagcagcctgacgccaaagcgttcggtaaaggcgtctttttcctgcgcggataaattgagatagaacatcacttcgcgcagatgatgctgcctgtccgttggcgtggcgggctggaccatcagcgtgcggatcatcatcgggatgcactcggtcaccgtcgcctgatatttacgtacctgatcccagaaggccctggcgctgtacttctccaggagcacaaaggtgctgccggcggaaaaggctggcattgcggcggtacactggcagtcgatatgaaaagcgggcatcaccgtcatgtacacgtcatcatcgcgcagggcgatttgccaggcagagtaatagcctgcaaagcgcaggttatagtgggtaatcaccaccccttttggacgcgaggtggtaccggaggtaaacagaatttccgccgtatcgtcagtggataacgcgggcgtatagcacagcgtggccgactggcgtgcttgtagttgggaaaagtggctcacgccgtcgtcagccggaagctgctcgccaatcagacagatatgattaagcggagtgctattgtcctggcgtatttcacggtacataggataaaactgggcgctggtaaccagcagactcacctggctgttttgcaggatccaggcgctttcttcgcccagtaagcgggcattaatcggcaccataatggcgccgatttttgccagtccaaaccagcaaaagatgaattccggacagttatccagatgcagcgcgaccctatcacccttgcggatccctaagtaataaaaaaggttcgccgtgcggttaatctcttcattgagcgaagcatagctaaactgccgaacgattccctcacaggattcgaaaattaacgccgttttatctccgtacatcccggccaggtcgtcccacatctgacgtaagttttgtccgccaacgatatccatattgctttatccactgaaatcaggcgtgagcgctaaccggaaaaccgagtagcgcatcgcgtttaatcctcaactttggccaggcctttgccgaccagttccttaatatctgcttcgctataaccaatgtttttcagaatggcggcggtatccatgccgtgtgatggcatgccacgccagattttccccgggttgtttttaaatttcggcatgatgttcggccctttacaggtgcgaccgtccattgtttgccactgagtaatcgattcgcgggcaacgtactgcgggttaccttccagttccggaatggtgagcaccttcgcacaggcgatattcagctcagcaaaacgcgcctgaacgtcggcgatggtatgtgctgccagccaggcgtccagtttctcttcgacgagcgggccgtaagggcattccacgcgatggatgagctgcgtgccttccggaacttccggcgtaccgagaatgtgcgccaggccaatatctttaaaacactcgttgatttgcgtgatgccgaccaactccatgacgatgtaaccatcggcgcatttatacaggccgcaaccggcgtagtaggggtctttccctttcgtcatacgtggacagatttcgccgccgttgaagtagtccatcatgaaatactgacccatgcgcagcatcacttcgtacatggcgatatcgatgctttcacctttacccgtttcgcgtactttgtgcagggctgccagcgcggctgtcgtcgcggtcatcccggagaagtaatcggcggtatacgggaaggctggcatcggttggtcaacgtcgccgttttggatcagataaccactgaatgcctgcgcgatggtgttatacgccggaagattggtgtactcctcggtaccatactggccgaagccggaaaggtgggcaatgaccagtttcgggttatgttcccacagcacttcatcagtaataccacggcgggcaaaggccgggcctttactggcttcaatgaaaatatcggtggtttccatcagtttcagaaacgcttcccgaccttcatctttgaaaatattcagcgacagggcgtgcaggttgcggcgtgagagctgcgggtagttaggctgtacgcggatggtatcggcccatgcgacgttttcaatccagataacctcggcgccccattcggcgaacatctgtccggcgaacggaccggcgatttcgatccctgaaaaaacaacgcgtaccccagcaagaggaccaaaggttggcattggtaaatgattcatcgtttttctcctggcattttttgcggtatgtaggccggataagcacagcgccatccggcatgattgcctgatggcgacgccccgcgtcttatcaggcctacaagggatcgattagcggtattgcttgagtaccgcacgacccaacgtcaggatctgcatttcgtcagaaccaccagaaacacggtcaacgcgcaggtcacgccagaaacgcgtgatgcggtggttgcccgcgataccaacacctcccagtacctgcatggcggtgtctaccacttcaaacgcggcgttggcgcagaagtatttgcacatggccgcgtcgccggaggtaatagtgccgttatctgctttccacgcggcttccagcagcatatttttcatggagttcagtttgatcgccatatgcgcaaacttctcctgaatcagctggaaacggccaatagcttcaccaaactgcacgcgctgattagcgtaacgcgcagcgtcttcaaaagtgcacattgcggtaccgtagttggtcagcgcgacgaggaagcgttcatggtcaaactcttctttcacgcggttgaagccgttaccttcccgaccgaacatgtctttctcgtccagttcaacgtcgtcaaaggtgatttcacagcagctatccatgcgcagaccgagtttctccagtttgttgaccttgatacccgctttgctcatgtccacaaaccactcggtgtaaaccggtttatccggcgatgcaccgtctctcgccatgaccacgatgtacggggtataggcgctactggtgataaagcacttactgccattgagataaaccttaccatttttgcgtgtataagtggttttcagactaccaacatccgatcccgctcccggttcggtgatagcagagttccacatctgcttaccggtgccccggaacgccatgattttatcaatttgctcctgagtcccttcacgcaggaaagtgttaaaacctcccggcaattggtacaacacgtaagttggcgcgccaagacgtcccagttccatccagacggcggcgacggtaacaaaacccgcttccagaccgccgtgttcttccgggatcagcaggctatcaatacccatatccgccagcgcttttacaaaacgctcagggtagacgctgtcacgatcgcactcggcaaaataagcttcccagttctcactggccatcagttcgcgaataccggcgacaaacagctcctgttcgtcatttaagttgaaatccatctttcagcctcttgatcaattgggttaataagaattacttgtctttccagtgcactttggcgtctttaataaaggacagcgtcaccataatgttgacgaagaacagcgggcatcctccggcgataatcgcggtctgaatcggcttcaacccacccagcgccagcagaacgataccgatgatgccgaccagcaccgaccagccgatgcgtactaacagaggcggctcttcaccatcgcgaacttcgcgacaggtcgacatcgccagggtgtaagagcaggcgttaatcagcgtgacggtggcaataaagcagaggatgaagaagccccacatggtggcggtgctgagcggcaaggctgcccaggtttcgataatggcgcgcgccacgccgtgttgctcaatcagttgcgggatgttgaggatgtttttatccatcagcagcagcgtgttactgccaaggactgtccacaggatccaggtagacgcggtcagacccatcaccatcccgaagcacagttcacgtacggtacgaccacgggaaatacgggccaggaagatactcatctggatggcgtaaataacccaccacgcccagtagaaaacggtccagccctgtgggaagccgcctttaccgatggcgtcggtatagaacagcatccgtggcaggtgcattaacagcatcccgacggagtcggtgaagtagttcatgatgaagctggcgccgctgacgataaacacccagccgagcatcaggaagctcaggtagctacgcacatcgctggcgattctgacccctttttgcaggccgcaggccacgcaaatcgcgttcagaatgatccagcaggtaatgatgatggcatccaattgcagcgtatgcggaataccgaacagccattgcatacactcggtgaccagcggggtagccagaccgaggctggtgcccatcgcgaagatcagcgccaccaggtagaagttatcgacgatggtactgaacaaccctttcgcatgcttttcaccgacgagcggtaccagcgtggagctggggcggatgacatccatcttgcgtacaaagaagaagtaggcgaaggccacggaaaggaagctataggttgcccacggtagcggcccccagtggaacaggctgtacgccaggcctatctctttcgcgcccgtggaattgggttccaggccgaacggcggggtggagatatagtagtagatctcaatagagccccagaacagaaccgcagcggatgtacaggaggcgaacatcatgaaaatccagctggcggtgctaaactccggtttttcgtcacctaatctctttttggcataggggccaaaaaccagccagaaccagctgaagagcatgacgaccatataccattcaaatgcccaaccccagacgttggtgacataactgaataccgcattaataacgacgttagcggcatcaagatctctgactgttagccagcaaagtatcccgacaattattaatagcggaaaaaaaaccttcggttcaattcccgattttctcttttcatttttcataagtgaattccagtgtgaaaacgaaatttatttagcgtgccagttcatgaacgtttgtttatttattattaatgatttgttgataagtttttaacctctgggacgcctcaatgagtaactcataatgggtattcatttcgggtgattctgttatctgtgtcacacttttttgcgttgattattttgtgtttaaattttgattttttctttatttatcaatctgttggttgtggttttttaacttttttaagtatctggcgttcaatattgttgagccagcaaacaatattgaaaattttcatatttggcatatttctttcaatattggtgaggtgcgtaacactattgaaagttacgaatatcaatgtgtgacattttcaatattggtgattaaggttttatttccgaattaaagagcgtgatatctgtatttaacaccgccgatataaatacgtttccttcatgatttctggagatgcaatgaagataattacttgctacaaatgcgtacctgatgagcaggatattgcgattaataatgctgacggaacactcgatttcagcaaagcggatagcaaaatcagccaatatgatctgaatgcaattgaagctgcttgccagttaaaacagcagttgggagacgctcaggttgtcgccatgagcgttggcggcaaagcgctgactaatgcaaaagggcgcaaagatgtcctctctcgtggccctgatgaactgattgtggtcattgacgatcaatttgagcaggcgctgccgcaacacaccgctaccgcgctggccgccgcggcgcaaaaatcaggtttcgatctacttatctgcggcgacggttcttccgatctttatgctcagcaggttggtttgctggtgggcgaagcgctgaacattccggcgattaacggcgtgagtaaaatcctctctcttaccgacagcacattgacggtagaacgcgaactggaagatgaagttgaaacgctgagcatcccgctcccggcggtgatcgcggtttccaccgacattaacaccccacaaatcccttcgatgaaagccattcttggcgcggcgaaaaaaccggttcaggtctggtcgcctgcggatatcgggctgaacagcgtacccgcgtattccacacaacaggttgccgcaccgaagcagcgcgagcgtcagcgtgtggtgattgaaggtgacggtgaagaacaaatcgccgcgtttgtcgagaatctgcgcaaaatcatttaattatcaggggatgttatgaacaaattttccagtgtctgggtattcagcgataccccttctcgtctgcccgaactgatgagtggtgcgcaggctgtaggtgaaaaagttaacgcgttcgtactgaacgaagcggacagcgcgacagcatgtcatttgggcgcggatcatgtctggctgctcagcggcaaaccagaagatcgcatgatcgaagactacgctgctgcgatggctgagactattcgtcagcatagcgagggcggcgcggtgctgctgccgaatacgcgtcggggcaagctgttggcggcaaaactgggctatcgcttgtcggctgcggtttccaacgacgccagcgacgtctccctgcaggatggaaaagcggcggtcaaacatatggtctacggcggtctggcgataggggcagagaccatcgcttcgccgtttgccgtgatcacactcagcagcggaacgtttgacgcacaacagccggatgcttctcgcagcggcgagatgcacaccgtgcagtggcaggctccggccactgccgtgacccgcaccgcaacccaggcgcgtcagagcaacagcgttgacctcgacaaagcgcgtctggtggtcagcgtgggacgcggcatcggcagcaaagagaatatctcgctggccgaagcgctgtgccagaccatcggcgccgagctggcctgttcccgcccggtggcggaaaacgagaagtggatggagcacgagcgctacgtcggtatctccaacctgatgctcaaacctgaactgtatctggcggtggggatctccgggcagatccaacacatggtcggcgccaacggcgcgcagacgattttcgccatcaacaaagataaaaacgcgccaatcttccagtatgcggattttggcatcgttggcgatgcgctgaagatcctgcctgcgctgacggctgccttagcgcgataaaccatttcgggcaggatacgaaggtatcctgccgctgacaggagtacgtatgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgtttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcttattccgttttgcgtagtaaatttgacgcctggctgatggagcaggccgaagaggcgggggcgcaactgatcactggtattcgcgtggataacgttgttcagcgtgatggcaaagtcgtgggcgtggaagccgatggcgatattctggaagccaaagtcgtaatcctcgctgacggggtgaattctctgctggctgaaaagctgggcatggccaagcgtgttgaggcatcgcatgttgccgtcggtgtgaaggaactgatcgaattgccgaagtcggtcattgaagatcgtttccagctacagggcaacgaaggtgccgcctgtctgtttgccggggcgccaaccgatggtctgatgggcggtggcttcctgtatacgaatgaaacaaccctttccctagggctggtctgcggtcttcatcatctgaaagacgcgaaaaaatcggtcccgcaaatgctggaagatttcaaacagcatccggccgttgcgccgctgatcgccggtggcaagctggtggaatatgccgcacacgttgtacccgaggcgggaatgaatatgcagcctgaactggtgggcgatggtgtactgattgccggagacgctgccggcatgtgtatgaacctcggctttaccatccggggtatggatctcgccatatccgcaggcgaagcggcggcgaagacggtgctttcggcgatgaagcgcgacgattttagcaagcagtcgttgggtgaataccgtcagcatctggacgaaggtccgatgcgcgatatgcgcatgtatcagaaactgccagcttttcttgataatccccgcatgtttaccgcctatcccgaaatggcggtcagtatcgcgcgcgacctgttcaccgtggatggctccgcgccggtgcccatgcgtaaaaaaatcctgcgccatgcgaagaaagtgggcttcatcaacctgatgaaagatggcctgaaaggagtgaccgtattatgacatctcccgtcaatgtggacgtcaaattgggcgtcaataagttcaatgtggatgaagatagcccgcacatcattctcaaaaccgatcctgataaacaggcgctggaggtgctggttaaggcctgtccggcgggactgtataaaaagcaggacgacggtagcgttcgttttgattacgccgggtgcctggagtgcggaacatgccggatcctcggccttgatacggcgctggaaaaatgggaatacccacgcgggacgtttggcgtggagttccgctacggctaataagtacgagtttgtgcccccgtaggccggattagatgcggtagcgtcgccatccggcaatcatgtggcgccaatgccggatggcggcgtaaacgccttatccggcctacagatgacgctttgcccgtgttgaaacaggacatcaccatgccgcagcccaggaactttgacgaccttaaattctcctccatccatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattgctggtgatgcgcgttttaattggcattgttatcggcgcggattaccctatcgccacttccatgattacggagttttccaacacccgccagcgtgcgttctccatcggttttatcgccgcgatgtggtacgtcggcgcgacctgcgccaacctggtgggttactggctgtatgacatggaaggaggctggcgctggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagccgccgcaggagacccgcttcctgcagctgtttaaccgccgtcatttcccgtttgtactgttcgttgcggctatctggagctgtcaggtgatcccgatgttcgctatctatacctttgggccgcagatcgtcgggttactcggctgggaacaggggcgcaacgcggcgctcggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggtatcatactggtcgtggtggcgtttgcggtatacgccttcttttccggcggaccgggcatactgcaatggctttatcctaatgaactcttccctacggatattcgcgcttcggccgtgggggtcatcatgtcattaagccgtatcggaaccattgtctccacctgggcattaccgatttttattactcgttacggtattaataacgtcatgctgattggcgcgttgatttcgttagtcgggcttggcgtatcggtgatgtttgccccggaaactcgcggcttgacgctaacacagaccggaaacatgactttgcgcggaacgccatcggataaccctcgttaagagtgttctgcatttctccctgcttttcgccaataacgctacagttaacagtcacatgctaaaacaactgaaaagcagggagaacaccatgcaaaaacgtcttatgaccgcactgtttaccgcagcaacactattcaccgtcgcaggatgctcttctaaccaggcggttgaaaccacggatggcaaaactattgtcaccgacgggaaacccgaggtcgataacgataccggtatggtgtcttacaaaaacgccgccaccgggaaaaccgaacagattaaccgcgatcagctgaaaaatatgagcgagctggataattaattcaattttttctggttagccgcgcaataatattctctctttatgcgcatccatttattcccatgcgaataaacggatgcctgaactggcagggacgccggaaaacgtcgaaatacgttcgcccgtgttcccgctttccccaccgcgctgtccgcttacatgaggttacactcatcgacatttctctgaacagcggctcaacatttcccggaaaaaacatatcgcaaggcatttatccttatgattaggtataaatgattaggtataaggaaacggagtctgtaatgaaactgaaactaatacctttttatttgctcgcgctattttctgccgcctccggggctacggagataaacgcctgcaaagacctgatcggaacatggaaaaccactgcagataacccgccttataccatgacaatattgccgccagtagaaggctgcggggaaaaatgtgtgaaactgaacgtacagtatgaacttgacgtgactcaccgcaacgcgctttattgccatgaaggacaagagggggtaaaagggcagggacccatggtgatagcatttgaaggggcgtatggtggacacgctattggaacctataaccgacagctgcaattactttgggctggcgtaataccgaaaaataaaaaggggaaatggataacgaaaatggaaaattactggttcaggcaggtaaaagcgcactaaatattaccttaaaacagcccgcaaaaccgtcttattcacgaagggcttactgcctgcgcgcgcacattccaacggcttgcctgccccggatgaactgttgataaaaaagagggccagcatctgtttccagacggccctgagtggattgtgacgtaacatggcaccttgctggcgctctcttattatttcatgccagtgccatcgttatggcgcaatcagagctttatttcgtcgcatcgttataaacttcggcaacggcttcaaaattcggaccatgctcacgtgcagcgataatatggtaatattttccgcctttcgcatcggctaattctgacagtttttcgcgtagatcagagggtgaggaaatctgcccgccactctgggacacatttatggtgccgaccttaaccagtttgaagtggctgatttcttgcttagagacctgctctgccgcaagtgtgctgaatgaagcaaccgttgccagtaatgcggcggcaatgatgcgttttttcatagttctgttcctgttgcattgatgataaggtttgcgcaatatcagtaatccgtaacgaaattatttatacccttcatacttcaggttgcttatgtgttggctacggattactcggcccacccatgggcctcgccctgacgggccgtcgcacgcgacgttcaaatctgctcccggcagatttgtcgctcacctcagtcacataattatctatgctcctggtgactcactcccttgccgcctttaagcaactcgaattattttgggtaataacctcggttgattatctgaaaatagccttatttggtgtgaccgtcttatatcttgttatagtcacctctttatgttgttgtcaatgtaaaataatgcgctgccagctaaaaagaaacttaaccccctgtaaataatagtttttatattatttcttttaatggcgtaatttttattgaatcacgcgacaatacgctagttttattcataagcaacataacagaattgagttatgttttaatttcccagagtgatattaccggttgtatgtctatggttgcgcggcctgttactgatagtgtttctttcggggcgattttattgtaacggcatagggtaatcaccgtagctgaagggaaaaggcacgaacacagcgctatagagtatgtttaataatgtatttttttatgaagtaatgtctgcagttgtatctctaaaataaaaacaatgaacttttcatctaaataatttttcagtgaattatggttatttattaatatatttctaatttgaaatacaaatcaatttataacacatattcttacccggaaggcattgatacatatccacgcttcctcgtacagtaataaatgaatatgtgataaagttactgactacaggtataataatatgagtaataaaaaaaatctgtccgcagaagagacggatcttacgcgtaggaaactgttaaccagcgccggtattcttgccgccggcggtatgctatccggcgcggtaaaggctgatgaaaaatgcgccgtcaaggcgaaaccgacgtgggataaaccgtttactggcgaaatcccggaaaaattgccagaaggatataatattctgttagtcgtgaccgactaggagcgtttttttcctacgtttcctttccctgtacccggcagagagcggctcatgaaaacgggggtgacattctgtaatcatcagaataccagtaatgtctgtacgccttcccgctccgtattgtataccggcttacatatgccccagacaaagatgtttgataatctgggattaccctggatgccttatgaccttgaccccgctcttggaaccacaggccatatgatgcgggaactgggatactatacggcctataaaggtaagtggcatcttacagaaaaactggagaagcctttgcctgacgaaaaagatgaggatattgatgtcggggatattcctgaaccagaattacataaaattatggaaaaatatggttttgctgactatcacggcatcggcgatattataggccatagtaaaggcggctatttttatgattcaaccaccacggctcagactataaattggttaagatgcaaggggcagcccttgaatgaccaacacaagccctggttcctggccgttaacctcgttaatcctcatgacgtcatgtttattgataccgataaagaaggagaaaaggtacagtggcgtggcgagttggatcaggatgataataccctggcgcccacgcagccgccggaaaacgagctttatcaggcaagctggccgaactatccgctgccggcaaacaggcatcaatcattcaatgagcagggaagaccgccggcgcatcttgaataccagacggcgcgcgctgcgctggaagggcagtttcctgatgaagatcgtcgttggcgtaaactgcttgactactatttcaactgtatccgcgattgtgatactcaccttgaccggatattaaatgaactggatgccctcaagttaactgataaaacgattgttgtatttactgccgatcatggcgaattaggcggaagccatcagatgcacggtaaaggcgcttccgtttataaagaacagatccatgtaccgatgattatttcccacccggcgtaccccggtaataagaaatgtcaggcgttgacctgtcatcttgatattgcgccgacattagttgggctgaccggtttgccggaagaaaaacagcaccaggcgttaggcaaccgcaaaggcgttaattttagcggattgctaaaaaacccggagagcgttgcggttaatgcggtgagaaatgccagcttatattgctatggcatgatcttgtataccgatgcccattatctccaccgtgttatcgcgctacaaagagataaacaaaaacggtggcgcaaatcaagcaggaaatatcgcatttgcatcctgatttcagccatcgttcagggacgcggatgattaacgatggccgttataagtttgcacgctatttctcgctaagggagcataatacgccggaaacctgggaggatcttattaagtacaacgatcttgaactttacgatcttaaaaatgatcctgatgagaaccataaccttgctgctgataaacagaaatatcaggatctcattcttacgatgaatgaaaaactgaataaaattatcaaagacgaaattggcgtggatgacggcagttttatgccggatgcggcccgtgagccatgggatcttactattgagcaatttaaccgcatggcgaaagattaagagcctgacccattaggttaatttatgcgtcggtgatctagcatccagcgtgtctggaggttcagatgctgttggcgctgcgcttattgggcctgtgtcatcatgtaatggattgatattacagtcattacaggaaaatttagcgcagcgccacccgacaagaaggccttaaaccgatttgtcagcaatttaaggctgccatcatcaccaacctttccacaccggatcgcgcttttccacaaacgcctgcggcccttcgagggcatcttccgggggcaggatggcgtcaactccttgctggcgttaattcaattttttctgattagccgctcaataatattcactattagcctggcgaatttgtcactacactttgtgataaaaaacagatcatcacaggctaatcatgatcctcattatttatgcgcatccgtatccgcatcattctcatgcgaataagcagatgcttgaacaggcagggacgctggaaaacgtcgaaatacgttcgctttatcacctctatcccgatttcaatattgacgtagccgccgagcaagaggcgctgtcgcgcgcgagtcttatcgtctggcagcatccgatgcagtggtacagcgtccctcctttactcaaattatggatggataaagtcctcacccacggctgggcttacggtcatggcggtacggcattgcatggtaaacatctgctgtgggcggtaacgaccggcggtggtgaaaaccactttgctatcggctcccatccaggatttgccgtcctttctcagccgctacaggcgacggcgctctattgcggcctcaaatggctgccgccgtttgccatgcactgcacgttcatttgcgatgacgacaccttacaggcgcaggcgcgtcagtataaacagcgtttactggcatggcaggaggtgaatcatggatagccatactctactgcaggcgctgatctatcttggttcagcggcgttgattgtgccgattgcggtacgtttgggcttaggatcagtgctggggtatctgattgcgggttgcattatcggcccctgggggctacggctggtgacggacgccgaatctattctgcattttgcggaaatcggcgtcgtgctgatgttgtttgttattgggcttgaactggacccgcaacggttatggaagctgcgcgcctcggtatttggcggcggcgcgttacagatggtggtctgcggcggactgattggtctgttctgtatgtttcttggcctgcgttggcaggtggcggaactgattggcatgacgctggcgctttcgtccacggctatcgccatgcaggcaatgaatgagcgtaacctgaccgtttcacaggtagggcgtagcgcatttgcagtgctcttgttccaggatatcgcggcgatcccgctggtggcgatgattcctctgctggccgccagcggcgcatccaccacgcttggcgcgtttgcgctatcggcgttgaaagtcgcaggcgcgttggcgctggtggtgttgctgggacgctacgttacgcgcccggcgctgcgctttgtcgcgcgttctggtttgcgggaggtgttcagcgccgtggcgctatttctggtgtttggtttcggcctgttgctggaagaggttgggctgtcaatggcgatgggcgcgttcctggcgggcgttctgctggcgagttcggaatatcgtcatgcgctggaaagcgatattgaaccctttaaggggttgctgctggggttgttctttattggcgtcggcatgtcgattgatttcggcacgctggtggagaatccgctgcgcattctgctgttgttggccggttttctggcaatcaaaatcgtcatgctgtggctggtcgcgaggaccctgggcgtaccggcaaaacagcgtcgctggtttgccgtcttattaggccagggaagtgagtttgcgtttgtggtttttggcgcggcgcaaatggcggatgtacttgagccggaatgggcaaaagcgctgacgctggcggtcgcgctgtcgatggcggccacgccgatttttctggtgctgctgacgcgcatggaaaagaccgcaacgggtgaagcgcgcgaggcggatgaaatcgacgaagagcagccgcgggtcattgtggccgggtttgggcgatttgggcagatagccgggcgtttactgctgtcgagcggggtgaagatggtggtgctcgatcacgaccccgatcatatcgaaacgctgcgtaaattcggcatgaaggttttttatggcgacgcgacgcgtatggatttgctggaatctgccggagcggcgaaggcggaggtattgattaacgccattgacgatccgcaaaccaatttgcaactgagtgaactggtgaagacgcatttcccgcatctgcagattatcgcccgcgcccgtgatgtcgatcattacattcgcctgcgccaggctggtgtggcgatgcccgaacgtgaaaccttcgaaggcgcgctcaaaagcgggcgacaggctttggaggcgctggggctggggcgttatgaagcccgcgagcgcgcggatctgttctgtcattttaatacccggatggtggaagagatggcgaaaggggaaaacgatccgttatctcgcgccgccgcctataaacgtaccagcgcgatgttgagcgaaattattaccgaggaccgggagcatctgtcgttgattcagcgccacggctggcagggaacggctgagggcaaacattccgggaaggccgctgatgaacccgaggtcaaaccgtcaatctaaagtaaaaaatgtgatgttctgcaaactttactgctaattggctgtttttgaactactgtaatgctggcgctccacatcaaatgagtggcgtcgccagcagaacgaaaaattttcgtgctcatcctcttttcgtcagtcgacgaaagattgcgctttacgtatagtggcggcaattttttttgtatcaggaaataattaatgatcagtctgattgcggcgttagcggtggatcgcgtcatcggtatggaaaacgccatgccgtggaacctgcctgccgatctcgcatggtttaaacgtaacacgttaaataaacctgtcgtcatgggacgtcacacctgggagtccatcggacgccccttaccgggacgtaaaaatattattatcagcagccagccgggcaccgacgatcgcgtgcagtgggtgaagtctgtcgatgaggcgattgccgcttgcggcgatgcgccggaaattatggtcattggcggcgggcgcgtgtacgagcagttcctgccaaaggcgcagaagctttatctgacgcatattgatgcggaagtcgaaggcgatacccattttccggattatgaaccggatgactgggaatcggtattcagtgagtttcacgatgccgacgcgcagaattctcacagctattgtttcgagattctggagcgtcgttaacgctgtagtgccggatggcggcgaaatgccttatccggcctactcttgagccggatgtaggcctgataaacgtagcgccatcaggcataaacctatcaggcgttgaccgcttcgccttcgcccatatccatctggcggtttgacggctgcacaaaatactgtttatcttcccaacgtaaacaggttaactccccgccccagcagcagccggtatccagcgcgtaaataccttctggcgtccctttcccttccagcgacgcccagtgcccgaaagcaatactgtaagcctcgctcaccggtcccggaatggcgaaccacggcttcagcggcgcaggggcattttccggcgacgctttgctgtacatatccagttgaccgttaggaaagcagtaacgcatacgggtaaaggcattagtaataaagcgtagccgcgccagaccgcttaactccggcgaccagttattcggcatatcgccatacatcgcgtcgaggaaaaacgggtacgagtcgctcgacagcaccgcttcaacatcgcgggcgcactcttttgccgtctgcaaatcccactgtggggtaatacccgcatgcgccatgaccagctttttctcttcatctacctgcaacagcggctgacggcgtaaccaattcaacagctcatcggcgtccggcgcttcaagaagcggggtcagccggtctttaggtttgttgcggctaatcccggcgaatacggccaacaggtgtaaatcgtgattccccagcaccaaacgcacgctattgccaagcgatttgacgtagcgtaacacgtccagcgaaccgggaccgcgggcgaccaaatcgccagtcagccatagagtgtctgtatctggcgtaaattccacttgctgtaataaggcgatcagttcgtcgtagcaaccgtgaacgtcgccgatgagataagttgccattgttataattttagtgaatgagtgtagggacggcgagtcgaaacacgggaatgtcgatggtaaaggcgtcgccattttcatcgatcatttcgtaatgaccctgcatggtgcccagcggcgtttcaattaccgcgccgccggtgtactgatactcttcgccaggcgcaatgcgcggctggacgccaaccacacctttgccctggacttcagtttcacggccatgaccattggtaatcagccagtagcggcccaatagctgcactggcgcccgacccagattgcggatggttacggtataggcaaaaacgtaacgttcatcgtcaggtgaggattgcgcctcaatgtagacgctttgcacctgaatacacactctgggcgaattgatcatgtttaactctccttcaaaggcgcgttttccgacagatagttggccatctggcagtactgcgcgacagagatattttccgcgcgcattgccgggtcaatacccatttccgtcaacgtctcaacgctaaaaagattgccgagactattacggatcgttttacggcgctggttaaaggcctcggtggtaatacggctcaacacgcgaatatctttaaccgggtaaggcatcgttgcgtgtggaaccagacgcaccacggcggagtccactttgggcggcggcgtgaaggcggatggcggcacttcaagcaccgggatcacctgacagtaatattgcgccatcacgcttaaacgaccatacgctttgctgttcggccctgcaaccagacgatttaccacttctttttgcaacataaagtgcatgtcggcaatggcatcagtatagctaaagagatggaacatcagcggggtggagatattatagggcagattgccgaacacacgcagcggctggcccaactgcgcagacagttcgccaaagttcatggtcatggcgtcctgctgataaatagtcagcttcggccctaaaaacggatgggtttgcaaacgcgccgccagatcgcggtcaagttcaatgaccgtgagcttatccagtcgttcgccgaccggctccgtcagcgccgccagaccggggccgatttcaaccatcgcctggcctttttgcggattaatagcagaaacaatactgtcgatcacaaaccgatcgttgagaaagttttgcccgaagcgtttacgggctaaatggccctgatggactcgattattcattgggtattaacaatcattttgatggcgagattaagcgccgtaataaaactgccgacatccgcttttcctcggcccgccagttcaagcgcggtgccgtgatcaacggaggttcgaataaaaggtaggccgagcgtaatattcactccccgaccgaatccctggtattttagcacgggcaggccctgatcgtggtacattgccagcaccgcgtcggcattatcgagatatttgggctgaaacagcgtatcagcaggtagcggcccgttgagtttcatcccctgcgcccgcagctcgtcgagcaccggaatgatggtgtctatctcttccgtgcccatatgaccgccttcgcccgcgtgcggattcaggccacagacaagaatgcgcggttcggcaataccaaatttggtccgcaaatcgtgatgcaaaatagcaatcacttcgtgcaaaagcgcaggggtgatggcgtctgcaatcgcccgtagcggcagatgcgtggtcgccagcgccacgcgaagttcttcggttgccagcatcatcacgacttttttcgcctgcgaacgctcttcgaaaaactcggtatgaccggtaaacggaatgcctgcgtcgttaataacgcctttgtgcacggggcctgtgatcagcgcggcaaattcaccgttcagacagccatcacacgctcgcgccagcgtctctaccacgtaggggccattttctaccgtcaactgaccggggatggcaggcgcgcgcagcgagaccggcaatagggtcagcgttcccgcgggctgcggcgcagcggggacatcaggcgagtaagggagaagcgagaggggcaggccgagcatggcggcccgctccgtcaggagcgcgccgtccgcacagacgaccagttcaatcggccacgcgcgttgcgccagttggacgacaagatcggggccaatcccggcgggttcgccgggagtgataacaacgcgttgcgcactgctcattagttactcaaaatcttaacgtaagcgctggcgcgctgttcttgcatccaggtcgccgcttcttctgagaatttacggttcatcagcatacgataagcgcgatctttctgcgccgcatcggttttgtctaccttacgcgtatccagcaattcgatcagatgccagccgaaagaggagtgtaccggcgcgcttatttggcctttatgcagcttcgttagcgcgtcgcggaacgccggatcgaaaatatctggcgtagcccaacccaaatcaccgccttggttagcggagcccgggtcctgagagtactctttcgccgctgcggcaaatgtggttttaccactcttaatgtcagccgcgatttcttccagcttcaggcgcgcctgctgatcgttcatgatcggcgacggcttaagcagaatgtgacgagcgtgaacttcggtcacggagatactctggctctgaccgcgcaggtcgtttactttcagaatgtggaagccgacgccggagcgaatcgggccgacaatgtcgcctttcttcgcggtgctcagcgcctgggcgaaaatccccggcagctcctgaatacggccccagcccatctgaccaccttttaacgcctgctggtcggcagagtaggtaatcgccagtttgccgaaatctgcgccgttacgcgcttcttcaacaatgctttccgcctggcgctgcgcgtcgttaacctgctcggaggttgggttttccggcagagcaatcaggatatggctcaggttcagctcggtgctggcgtcgttttgggtgccaatctgttttgccagcgcgtcaacttcttgcggcaaaacggtgatacggcgacgaacttcgttgttgcgcacttcagagataatcatctctttacgaatctggttacggtaggttgaatagttcagcccatcgtaagccagacggctgcgcatctgatccatcgtcatattgttttgtttggcgatgttggcgatggcctgatccaactgctcatccgtgatcttcacccccatcttctgacccatctgcaggataatttgatccataatcaaacgttccaggatctggtggcgcagcgtggcgtcgtccggaagctgctgacctgcctgacccgcgttgagtttgactgattgcattaagccatcaacgtcgctttccagcacgacgccattattgacgacggctgcgactttatcgactacctggggggcagcgaaactggtattcgcgatcatggcgataccgagaagcagcgttttccagttcttcatactttttccatttcaattaaccgcaatgcggattacgttgtaaatcaatcagattacatagagctttggtacggcagaatgttcgaacgcaacatttcttgcgtgccgaggccgtagttagagctcaaaccgcgcagctcaatgttgaagccaatcgcgttatcataaatcgcgtgttgtttatcgttatcccaaccgttcagcttacgttcgtatccgacgcggatcgcatagcagcaagagttgtactgcaagccgagcatctggtctgcaggtttgctcgaattggtatcgaagtagtacgcgccgacaatcgaccagcgatcggcaatcggccaacttgccaccgcgcccacctggttgatgccgtttttatactgctctgccgtggaataatacgaaggcaacgtagcctgaatatattccgggctggcatagcggtagttcaactgtaccagacgatcctgatcccgacggtattcgaggctgctgctgctggtagcgacgctatccagacgggtatcgtactgcactccgctacgcagcccccagcgttctgaaatacgccagtaagtgtcacctgcccaaaccagcgaaccggttttgtcgtcattctcccatttaatgttgtcatcgccggtgcgagactccgtgaaatagtagatttgaccaacagaaacgttaaaacgttcaacggcggcatcatcataaatgcgtgttgtgacgccggtcgtgacctggttggcggaagcaatacggtcgagaccgccataagtgcggtcgcggaacaggccgttatagtcggattgcagcaaagaagaatcgtagttatagatgccgctctggtcgcggtacggcacatacaggtactgcacgcgtggttccagcgtttgggtataccccggcgccagcatcgccatatcgcgttcgaagacgagcttaccgtcgactttaaactgcggcatgacgcggttaaccgaatcttccagttttttgctgttattggcgttgtaccagtccagattcgtctgctgatagtgcgtcgccatcagcttcgcttcggtgttcagactgccccagcggttggagagcggcagactaatggtcggctccaggtggacgcgggtcgcttccggcatattgtctttggtgttgacaaagtgcaccgcctgaccgtaaatccgggtatcaaacgggccgagatcgttatggtagtagttaacgtctaactgcggctccgctgaatagctgctggtgttctgatcgttaaagacctggaattgtttggtcgacaccgtagcgtcaaagttttgtacggcgtagccgacgctgaatttctgcgttgcgtagccgtcggtactggaaccgtacttactgtcgaaatcattaaagtagctggagtcgctgactttggtgtaatcgacgttaaaacgccacacctgatccatcacgcctgagtgctgccagtagaataaccagcggtgcttatcgccctctttgggatgttcgtcctcgtagactttatcagaaggcagataatctaattccatcaacccggcgccggcctgcgtgagataacggaattcgttctcccacataatattgccgcggcggtgcatatagtgcggggtgatggtggcgtccatattgggcgcgatgttccagtaatacggtaagtagaactcgaaatagttcttggtcgtgtatttcgcgttcgggatcaggaaacctgagcgacgtttgtcaccgacgggtagctgtaaataggggctataaaagatcggaaccggacctactttaaaccgggcgttccagatctccgcaacctgttcttcacggtcatggatgacttcactccccaccacgctccaggtatcggagccaggcagacaggaggtaaagctgccgttttccagaatggtatagcggttttcgccacgctgcttcatgagatcggctttaccgcgcccctgacggcccaccatttggtaatcgccttcccagacgttcgtgtctttggtgttcaggttcgcccagcccttcggccctttaaggatgacctgattgtcatcataatgcacattacccagcgcatcgacggtgcgtacaggttccggctgaccttccgcctgcttctgatgaagctgcacttcatccgcttgcaggcggctattcccctgcataatgtccacgttgccggtaaaaacggcatcgtccgggtagttacctttagcgttatcggcattgatagtaaccggcagatcgttggtatcgccttttaccagaggacgatcgtagctcggcacgcccaacatacactgtgaggcgagatcggctgccagcccctgatgactataaagggcgctggcgatcatggtggccagaagagtgggaatacgttttttcatacgttgtatttattgttccatcatcggtagcgttgcgcgtgacaaacggtcacagcctaacttactcatcttcgctgcgccagtgttaatcctgccgtttagcgtctgtggtgttaggcacggcattgaatgacaggtatgataatgcaaattataggcgatgtcccacaaatgaccgtagccttcattcgcggaaaagcaccttattttgtgggagatagcctcaccgatagcgtaacgttttggggagtctatgcagtactggggaaagataattggcgtcgccgtagccctgatgatgggcggcggcttttggggcgtggtcctgggtctgctggtgggccatatgttcgacaaagcccgcagccgaaaaatggcgtggtttgccaaccagcgggaacggcaggcgctgttttttgccaccacctttgaggtgatgggccacttaaccaaatcaaaaggacgggtgacggaagcggatattcatatcgccagtcagttgatggatcgtatgaatttacacggcgattcacgtactgccgcgcagaacgcctttcgggtcggaaaagcggataattacccattacgtgaaaagatgcggcagtttcgtagcgtctgcttcgggcgttttgatctgatccggatgtttctggaaattcagatccaggcggcgtttgccgatggttcactgcaccctaatgagcgggaagtgctgtatgtgattgcggaagagttaggtatttcccgcgtacagttcgatcagtttctgcgcatgatgcagggcggcgcgcagtttggcggcggttatcatcaacagtccggcggcggctggcagcaggcgcagcgcggcccgacgctggaagatgcctgtaatgtgctgggggttaaaaccaccgatgatgcaaccaccattaaacgcgcttatcgcaaactgatgagcgagcatcatcccgataagctggtggccaaagggttgccgccggaaatgatggagatggcgaagcaaaaagcgcaggaaattcagaaagcgtatgagctaatcaaagaacagaaaggcttcaagtgattgaattgccggatgcggctagcgccttatccggcctacgttaatgaatgtaggccgggcaagcgaagcgctccggcataaattggctcagaatttaaaaatctgccgggactttaaacgtcatgctgttaccgtaagcgggatgggtaatggtcagcatttcggcgtgtaactgcaaacgcggcgccagcgacaacgcttccggcgaggcgtaaaactgatcgcctaagatcgggtggcctaacgccagcatatgcacacgcagctgatgcgaacgcccggtgatcggtttgagcaccacgcgggcggtattatccgccgcaaattccaccacgttatattccgtttgcgccggtttgccggtttcataacacactttctgctttggccggttcggccagtcgcagatgagcggtaagtcgaccagtccttccgccggggagggatgcccccatacgcgcgccacatactgctttttcggctcacgttcgcggaactggcgttttagctcccgctccgcggctttggtcagcgccactacaatcacgccgctggtggccatatccagacgatgcaccgactctgcctgcgggtagtcgcgctggatacgcgtcataatgctgtctttgtgcgcttccagacgccccggcacggacaacaggccgctgggcttattgaccaccataatgtgctcatcctgatacaggataaccagccagggttcctgcggcggattgtagttttccatccccatgtacggctccgttattggtgcgtgacgacgataagacgcagcgcgtccagacgccagcctgcctgattcaggctttccagcacctgctgacggttgctgtcgatagcggcaagttcgtcgtcgcggatgttcgggttgacggcgcgcagcgcttccagacgcgacagttccccggacagtttttcatctgcctcgcggcgcgcgttatcaatcagcgctctggcggactgttcaatctgcgtctcgcccagttgcaaaatggcgtggacgtcctgttgaacggcgttcaccagtttgctaccggtgtggcgattcacggcgctgagctggcggttgaaggtttcaaactcgacctgggcggccagattgttgccgtttttatctaacagcatacgtaccggcgtcggcggcaggaagcggttcagttgtagctgtttcggcgcctgcgcttccacgacgtaaaccagttcgaccagcagcgtgccgacgggcagcgctttatttttcaacagcgaaatggtgctgctgccggtatcgccggagaggatcagatccagtccgttacggatgagcggatgttcccaggtaataaactgcgcatcttcgcgagacagggctacgtcacgttcaaacgtgatagtacaaccgtcttccggcaggccggggaaatccggcaccaacatgtggtcggacggcgtcagcacgatcaggttgtcgccgcgatcatcctggttaatgccgacgatatcgaacaggttcatggcgaacgcgatcaggttggtgtcgtcgtcctgttcttcaatgctttgtgcaagctgttgggctttttcaccaccgttggagttgatctccagcaggcggtcgcggccctgttctaactgggcttttagcgcttcatgttgttcgcggcaggatttgatcagatcgtcaaacccgtcggtttcttcaggcgcggccagatagttaatcagactggcgtaggctgaatcataaatcgcgcgaccggtcgggcaagtgtgctcaaaggcgtccagcccttcgtgataccagcgaaccagcaccgactgggcggttttttccaggtacgggacgtggatctggatatcatgcgcctggccgatacgatccagacgaccaatacgctgttccagcagatccgggttaaacggcaagtcgaacatcaccagattgctggcaaactggaagttacgtccttcggagccgatttcggaacataacagcacctgcgcgccggtatcttcttcggcgaaccaggcggcggcgcggtcgcgttcgataatcgacatgccctcatggaacacggcggcgcggatgccttcgcgttcgcgcagcacctgctccagctgtaacgcggtggtcgccttggcgcagatcaccagcactttttgcgaacgatggctggtcagatagcccatcagccactcaacgcgtgggtcgaagttccaccaggtgccggtatcgccttcgaactcctgataaatttgttccggatagagcatatcgcgggcgcgatcttccgcgcttttacgcgcgcccataatgccggagaccttaatggcggtctgatactgggtcggcagcggcagttttaccgtatgcagttcacgtttcgggaaccccttgacgccgttacgggtgttgcggaacagaacgcggctggtaccgtggcgatccatcagcatcgacaccagctcatcacgggcggcctgcgcgtcgtcgcgatcgctattagcggcctgtaacagcggttcaatatcctgttcgccgatcagatcgcccagtctgttcagttcgtcgttgctgagtttattgcccgccagcagcatggccaccgcatcggcgacagggcggtagtttttctgttcttcgacaaactgttcgaaatcgtggaaacggttcggatcgagcaggcgcagacgggcgaaatggctttccatccccagctgttctggcgtggcggtcagcagcagcacgcccggcacgcgttcagctaactgttcgatggccatatattcacggctcggcgcatcggtgctccacaccagatgatgcgcttcgtcgaccaccagcaaatcccactcggcgtcgcacaaatgttccagacgctgcttattgcggcgggcgaaatccagcgagcagatcaccagttgttcggtttcaaacgggttatacgcgtcgtgctgcgcttcggtatagcgttcgtcatcgaacagcgcgaagcgcaggttgaaacggcgcagcatttctaccagccactggtgttgcagggtttccggaacgatgatcaatacgcgttccgccgcgccggataataactgttgatgcagaatcatcccggcttcaatggttttacctaagcccacttcatccgccagcagtacgcgcggcgcgtggcgacgacccacatcatgagcgatattaagctgatgcgggatcaggttggtccgctgaccgcgcaggccgctgtatggcatccggtactgctcgctctgaaatttacgggcgcgatagcgcagcgcgaaccgatccattcgatcgatttgaccggcgaacagacgatcctggggcttactgaaaaccaacttgctgtcgagcagaacttcgcgcaacgtcacattggtttcttcggtatccaggcgggtgccgacataaacaagcaggccattttcttcttttacttcatcgatatgtagctgccagccttcatggcttgtaatcgtatcgccagggttgaacatgacgcgggtcacgggagaatcactgcgcgcatacaggcggttttcccccgtggacgggaaaagtaaggtgacggttcgcgcatccatcgcaacaacggttccaagtcccagctcgctttctgtatcgctgatccagcgttgaccaagtgtaaaaggcatatgtgttcggctctatatctttaattgcaggcattactcgccattcccaggcgacagcactggataattgcgagtatacgaccccgctaccaggctaatgtggtagtggcgttaattaggtccaggaatggaaagggcgctatggtactggaaggcggcgctttcgtcacgcgtcaaaataaccccagttgcccggtcagtagtgtagcaaaattatcttcaacgaagggaagaattccttccgccacgggttgtagctggcgggtaagatagtgttcgtaatccagcggcgactgctggtaatccacgggctcggggccgttaacagtccagacatattttatggcgccgcgattctgatactgcgccggacgaccctgcttcaggttttgttcatccgccagccgggcggcgcgaacgtgcgacggaacgttacgctggtactcatgtaaagggcgacgcagacgcttacgataaaccagctgcgcgtccagttcgcccgccatcagtttatcgatagtctcgcgcacatagtcttgataaggttcattgcgaaaaacgcgcagatacagctcctgttgaaagcgctgcgccagcggcgtccagtcggtccgcaccgtttccagacctttaaataccatgcgctggctgtcgccttcctgaatcaggcccgcgtagcgttttttactgccagtatccgcgccgcggatggtcggcatcagaaaacggcaaaagtgagtttcaaactccagttccagcgcgctggtcaaattttgctgttgtaacgtctgcgcccaccattcgttcacgtgacgcaccagcctgtgcccgatttccgccgcatcggcttctgaatgcgcgcgccggagccagacgaaagtggaatcggtatcgccataaatcacgtcataaccctgcgcctcaatcagcgctttggtctggcgcataatcgcatgaccgcgcatggtgattgacgacgccagacggggatcgaaaaagcgacaggccgtggtgccgagtacgccataaaaggcgttcataatgattttaagcgcctgcgagagcggtttattgccctgacgtttggcttcatcgcgcccgtgccagatttggctaacaatttccggcaggcagtgcttttctcgtgaaaaccaggcgtcaaggaaaccttcggtactgtgttccgggtccggctgcgccatgccttcgaccagcccgacgggatcaatcaaaaacgtgcggataattgacgggtacaggcttttataatccagcaccagtactgaatcgtataatccgggttgtgaatccattacgtagccgccgggacttgccagcggcggcacttcgccgagattgggcgcgatatagccggcgcggtgcattcgcggaaagtaaagatgcccgaatgcggcgaccgaaccgccgtggcgatcgaccggcaggccgttgatcgtcgcgcgttccaacaaaaacggcatgatttcggttttatggaaaatgcgcgtgaccagctcgcagtctttcaggttgtaggtggcgagggcgggtttatcctgggcaaagcggcgatcgatctcatccatacgatcccaggggttatcaatggattttccttcgccgagcagttcctgcgagacggcttccagcgaaaaagacgaaaaattccagaacgcggatttaagcgcgtcgataccatcgataatgactcgccctctggcctgggcgaaaaaaacgccgtttttgaagccatgttcgcgccactccagttcgctattgtctcgccccagccgtaaagggatacggtagcgttcggcatatttttgcagcatacgcaggtcgaactgcaccacgttccagccgatgatgacgtcaggatcatgttcggcaaaccaggcgttgagtttttccagcaactgcgggcggctggcgacatacacaagctcgaagtccagttggcgctcatcgccgttcgccgggcccagcatataaacggtacgctggccgcagccttccagaccaatgcaatacagctcgccgtgtcgcgtggtttcgatatccagcgagacccattttagcggcggtcgatagtcggggtggggtttaagacgcgcattgcggataacgccgttgcgcatctcgccatctacccaaacaggcgaagtgataaaacgttccatcaggtaacgctccggcgggcggacatccgcttcataaacggtgacgccgttttcgcgcagcagtttctccatccgcataagctggcggtgagtgcggcaatacagaccggataccggctgacggtgaaagtctcgcagctggagcggcgtcaggcgatagtctttttccgcctgtagcagcgaggcggcgcgggaggtctggctggtcggaataaacgccacggactcttgcggcgccagcgtcgcctgcaaagggccgttgtctgtcgccagccagaaagagacctccgtcccttgcggcgtatcccgccagtgccgggttaaaatgaaacctgcctgcgccacgatgattacctgtctaaaaaattcacgctaattataacctgttttagggggtaatactgttattttgtacaggcatataacgtaaaagccgatatccgctgtaataaaaagtttctcgcagtaagaagcgggtttgcgcccaccaggatttatagcgggtggctcgcgtgggtgatgagcggctatcgataccattatcctgagcgatagttttcagacgcagcatatgcagcggatcgctgaccagtaacgctgtgcaccatcttaactccaaagggtactcccgccgacataaggcgggaggggaatttggacgggcttgaaaagcccgaaggatcatcagccacgctgatgttgaatgtattgcttcacaacttccagcggcgcacctccgcacgagccagcaaagtatgacctcgaccagagcacggcttttccgtatgctccccgcaaatcaataaattcgtttcgcagacggcgggatgtcacagctttcagtgagttaaccagtaccgaaagctgcactgttggtgggtattcgatcagcatgtggacatgatcgacgtctccgttactttctttaagttctccgccaaaatcacggcagacttctgctgcatactgatggaatgcagcatagtgtgactcacccagtatctttcgacggtattttgttataaagacaagatgaacatgcaaaaggaaggcggcatgtcttgaacgattaattttatgtttttgtattgaagttgaccgtaaaaacagtaacgtagcaaacaaatctcctacacactgagtgatgatgctaatcctgaaagcctacaaattcagactggaaccaacgcctgaacagtcgcagcgtttgcggcagttatgtggttgcgcccgttttgtctggaatttaggtcttgcggagacaaagcgcatccttggttcaggcgaaaagttaccttcggctttcgagttgaacaggatgcttacagtgtggaaaaaaatgccgggacacatctttttacaggatgcttataccgacaatctgcaacaaaagttgaaagacctgcatactgcatggaaacgttgctttgataaaaagctcgcagctaaggccccggtatggaaacgaaaaaatgagggcagagactcaatccgttttgtgaactttgagaaatattgccgccttgaaaatcgcagagtgaagctaccgtcaggtcttgggtgggtaaaattccggcaatctcaacgtgtgaacggtaaaatcaaaaatgcgacaatcagtcagttagcgggacagtggtatatctcgtttcaggttgaagttgaaacggcagaacccaatcacacaagcacaacgatagtcggtctggacgcaggagtaacaaaactcgccacgctttcagacggtacggtataccaaccagtcaacagttttaaagcaagtcagcgcaagctggcaacactccagcggcagttaagccgtaaagtcagattcagcagtaactggcagaaacaaaagcgaaaagtccagcatctgcactcgcacatagccaatatccggcgcgactaccttcataaagttaccagtgaaatcagcaaaaaccacgcgatgatagtcattgaggatttgaaggttagtaacatgtcgaaatcggcaaaaggtacagcagaacagcacggacgaaacgtcaaggccaaatcaggtctgaaccgttcgatactggatcagggctggtatgaaatgcgccgccagcttgagtacaaacagctctggcgtggcggtcaggtgcttgcggttccgccagcatacacaagccagcgttgcgcgtgctgtggtcataccgcgaaagaaaatcgcctgtcacaaagtaaatttgtgtgtcaggcatgcggatatacagcgaacgctgatgtaaacggcgctcgtaacattttagcggcggggcacgccgttcttgcctgtggagggatggtgcagtcaggccgcccgtctgaaacaggaaccagacgctgagcaatcagtcgtcacccactaatgggaattccccacctgagtcacgaagtgcgaaggtgggggaggatgtcaatgttgttgtcgcagtatctgttttgcgtaacgaatattttcgcgcgtcacggtagagcgctcttcaataaaaatcgccttagccggaatgcctttttccagaacgtattgacgggctatcgccgcgtcggaaaccgttgcgccagcgccgtagccgccggttaataccaacgcgcggacaatgtgttgttggtaaagccagatggcatgatccagtctggcctgaaaaacgggagaaggcgtttttccgctaacgcctgctcctgcgacaatcgcgcagtcagctacgcgcgtctggttttgctgactgaactgataaatagcgatagcgttatggataaacaccatggccataatgagaatgatgcctgccgcgattctgaggatgtagcgatatttcatgaatgagttcgttccccgtgacgggtgtaatgaatattttaacgataaaatggcttttagcgtcagatatttttgctgacgtatatttatcaatataatgatgccggtatatacagcagatataattatcctataactgctaattttgaatcatgtttatttacagtttttacccatgtattagccgttttgtgtcaagtctgttttcatacattaagtatttttcagaaaggcgcttgttcgaatctgttacttatttctcggattaacaaaaaagcgatattttttgtttgttttaattaatgaaaagtgtaacaatttcatttggaacatccgcaccgtcaggtagaaatataatattccaattggccgctatggttaaataaaaatggattacagtgcgaattcgtcgggaactctctgcataatttaatttttattttagaatataattttattttgactttcgggtgcgggtgtttttatcaaaatttgtggtattcaggaatgatcttttatgaatgtgagtatgcaggcgcgtctggtagggagcgaccgttatcttttcgtcaatactcaacgcgctaacccttccataaaaaccgtgagtcgattttttgagtataaaacatggacagaacagatttggcgtaccgagattattgaaaacggcaatgctttttttcactggcaaggacacgacagaaaagacggacatcgggataccattattaattatctgttaaatgggcaacgctggcagtcaacaatcgaagattatattttcttccatgcgctggaaggaaaagcgtggcagggacattatgataatattattgaatatgtgagttctgatcattacgtctatcaaagcgcatttgctgaatatatcaccgaccagattcatcaacgcgccccccatgggacgcgtttttagaggcattactgcccgtaataggcttttgcgccgtgtttgcgtaaatagtgtttatccagcagggattgctgcatgtcgggcaactgcggcgcaagctggcggcagaagatccccatataggccacttcttccagcacgatggcgttatgcacggcatcctcggcatttttaccccaggcaaacgggccgtgcgaatggacaagcacgccgggcatttgagcggcgttaatgccttgtttttcaaaggcttcaacaatgacattgcccgtttcccattcatactcgccattaatttccgcctcggtcattttgcgagtgcagggaatcgtaccgtagaaatagtcggcgtgggtggtgcccgtcgccggaatcggctgacccgcctgcgcccagatagtcgcgtggcgcgaatgggtgtgtacgatgctgccgatagtcggaaatgcctgatataacagacggtgggttggcgtatcggacgacggtttcttatgaccttcaacgacttcaccggtctccaggctgaccaccaccatatcgtcagcggtcatgacgctataatcgacgccggacggcttaatcaccagtacgccgcgttcgcgatcgacggcgctaacgttaccccaggtgagggtgaccaggttgtgttttggcagcgccagattggcttccagtacctggtgtttgagatcttctaacattgttttctccctgccggatggcgcttcgcttatccggcctacgagcgacggtgtgccggatggcgacataaatgccttattcggcctacaggaccgtaggcccggtaaacgcagtgccaccgggcattcagacaccacttttagcgttttaaaccgtaatacacctcgttccagcgcagcgcgtccttaaaggctggcagacgggtatcgttatcaatcaccgcgatttcgatatcgtgtatttctgcgaactggcgcatatcgttcagatccagcgcgtggctgaagacggtatggtgcgcgccgccagccagaatccacgcttcggaggcggtcggcagatccggctgcgccttccacagcgcgttagccaccggcagtttcggcagggagtgcggcgtttttacggtgtcaatgcagttgaccagcaggcggtaacgatcgccgaggtcgatcaggctggcgacgatcgccgggccggtttgggtattgaaaatcaaacgcgccggatcttccttgccgccaatgccgaggtgctggacgtcgaggatcggtttctcttccaccgcgatggagggacacacttccagcatgtgcgagccgagcaccagatcgttgcctttctcgaagtggtcagtgtaatcctccataaatgaggtgccgccctgcagaccggttgacatcactttcataatgcgaagcagagcggcggttttccagtcgccttcgcccgcaaagccgtagccctgctgcatcagacgctgtacggccagacccggaagttgtttcagaccgtgtaaatcttcaaaagtagtagtgaatgcgtggaagccgccctgttccaggaaacgcttcatccccagttcaatgcgcgccgcttcccgcacgttctggcgtttatcgccgtggatctgggtggcgggcgtcagggtatagctgctttcatactcgtcaatcagagcgctgatatcgccgtcgccgatagaattcaccacctgcaccagatcgccgaccgcccaggtattgaccgaaaagccaaatttgatttgcgcggccactttatcaccgtcagtcactgcgacttcacgcatattgtcgccgaagcggcagacttttagctggcgggtatcctgtttagagaccgcctggcgcatccaggcgccgatacgcgtatgggcctctttatcctgccagtggccagtgacgaccgcgtgctgctggcgcatccgcgcgccgataaaaccgaactctcggccgccatgcgcagtctggttcaggttcataaagtccatatcgatgctgtcccacggcagggcggcgttaaattgggtatggaattgcagtagtggtttgttaaggatactcagcccgttgatccacattttggccggggagaaggtgtgcagccagaccaccagccccgcgcagcgatcgtcataattggcgtcacgacaaatggcggtaatctcatccggcgaggtgcccagcggttttaataccagtttacatggcagtttggcttcggtattcagcgcgttgaccacatgctcggcatgttgggtgacctggcgcagggtttctgcgccatacaaatgctggctgccaatcacaaaccatacttcataattatcaaaaatcgtcattgtcgtgtccttaatgagtcaggattgcctgattggccggggtcgttggcgccggcgcggcagtcggaagataatgttgttctgcgcttagcgcccactgctggtagcggcggtaaagccgttcgaagcgttgcgcctgttcagggcggggacgcagagtgcgttctaccgcgctcgccatgctttgctgggcggcaggaatatcggcatggactttcgcggcaacggcggcaaagatagcggcgcctaatgcgcaacattggtcggaagcgacgatctgcaacggacgattcagtacgtcgcagcagacctgcataatgacctgatttttacgggcgatgccgccaagcgccatcacgttattgaccgcgataccctgctcggtaaaacactcctgaatggcgcgcgcgccgaaggcggtcgaggcgaccagaccgccaaacagcgctggcgcgtcggtggcgagattgagatcggtaatgacgcctttcagacgctggttggcattgggtgtacggcgaccattgaaccagtcgagcaccaccggcaggtgatccagggacggatttttcgcccaggcgtcggtgagcgctggcaatagctgcttctggctggcgttaatctgggttttcagttccgggtgctgcgcggcaagttgttccagcggccagctcaacacgcggctaaaccaggcgtagatgtcgccgaaagcggactggcccgcttccagaccgataaagttcggcaccacgctgccgtcaacctgaccgcaaatgcctttcacggcgcgatccccgacgctctgtttatccgcaatcagaatgtcgcaggttgacgtgccgatgacttttaccagcgtattgggctgtgcgcccgcgccgaccgcgcccatgtgacagtcgaacgcgccgccggaaatcaccacgctttccggcaagccgaggcgctgcgcccattcggcgcacagggtgcccacgggcagatcggcggtgaaggtttcgctaaataacgggtagcgcagatgacggttaatgcacggatcgagttcatcaaagaagctcgcgggcggcagaccgccccagctttcatgccacagtgttttgtgcccagcgctgcagcggccacggcggatatcctgcgggcgagtggtgccggaaagcagcgccggcacccagtcacacagttcaatccacgagacggcggcctgcgcgacggcgctatcctggcgggtgacgtgcagaatcttcgcccagaaccattcgctggagtaaatgccgccaatatagcgggagtagtcgaccttacctggcttatggcacagacgagtgatttcgtcggcttcttccacggcggtgtgatctttccacagcacaaacatcgcattcgggttctcggcgaactccggacgcagcgccaggacgttaccgtcggcgtcaatcggcgctggcgtagaaccggtgctgtcaacgccaatgccaacgacatttgcgcgttgcgcggcgcttaattgtgccagaacggctttcagcgcggcctccattgactccatgtagtcgcgcggatgatgacggaactggttgttcgggccgtcgcaataacggccttcttgccagcgcagataccactctacgctggtggcgatctcgtcgccggtggcgcagtccactgccagagcgcgcactgaatcactgccaaaatcgaggccaattgcaattgccatcgtcttactccatccagaaaaacaggtatggagaaacagtagagagtcgcggcaaaaaccgtcaggcaggatccgctaatcttatggacaaaaatgctaatgctttgcaaagtgtgacgctgtgcaaatattcaatgtggacattccagccatagttatagacacttctgttacttaattttatcgcctgaactgtacgcttttgttacaaagcgcttttcacaagcggggttgatacgtgctttcatcaagcgcaaggtcttgcggagacggaagctctgtcgtcctggtcaatatggacaatttgtttcttctctgaacatcggggggtagagaaatcatggctgaaacgcaaaatgatccgctattgccgggatattcatttaatgcccatctggtcgccgggctgacgccaattgaagcgaatggatatctggatttttttatcgatcgtccgttgggcatgaagggatatattcttaacctgaccatccgcggagagggcgtcattaataataatggcgagcagtttgtctgtcggcctggcgatatattattgtttccgccgggcgagattcatcactatggacggcatccggatgccagcgggtggtatcaccagtgggtttatttccggcctcgcgcctactggcaggagtggctgacctggccgacaatctttgctcagacaggatttttccgcccggacgaggcgcgccagccgcatttcagcgaactgttcgggcagatcatcagcgccgggcaaggggaaggtcgctattctgagctactggcgatcaatctgctggagcagttgttgctcagacgtatggcggtaattaatgagtcgttgcatccgccgatggatagccgtgtgcgcgatgcctgccagtatatcagcgaccatctggcagacagtcattttgatatcgccagcgtcgcccagcatgtctgcctgtcgccctcccggttatcgcatctgttccgccagcagttaggcattagcgtattgagctggcgcgaagatcagcgtatcagccaggcgaaactcctgcttagcaccacgcgaatgccgatagcgaccgttgggcgcaatgttggatttgacgatcagctctatttttcgcgggtatttaaaaaatgcaccggggcaagtcctagcgagttcagggccagatgtgaataaaaagtgaatgatgtgtccacaaagatgtcataagccgtaactattcggataattgacggcttgacgaagggggacggggtaagcagaatccctgcttcatcacgctgacggacacactatgcaagcactgctggaacactttatcacccaatccactctgtattcgctcatcgccgtgttgctggtcgccttcctggaatcgctggcgctggtggggttgattttacccggcacggtactgatggcggggctgggcgcgcttatcggcagcggcgagctcaatttttggcatacctggctggtgggtattatcggctgtctgatgggcgactggatttcgttctggctggggtggcgctttaaaaagccgctacaccgctggtcttttatgaaaaagaacaagtcgctgctggataaaaccgaacatgcgctgcatcagcacagtatgttcacgatcctggtcggacgttttgtcggtccgacgaggccgctggtgccgatggtggcagggatgctggatcttcccgtagcgaaatttattgggccaaacttgattggctgtttgctgtggccgccgttttatttcctgccgggcattctggcgggagcggcaatcgatattccttccgatatgcagagcggagatttcaaatggctgctgctggcgacggcgttgctgctgtgggtcggaggctggctatgctggcggctgtggcgcagcggcaaagcggcagtcgatcgtttaaccgcgtatctcccccgcagccgtttgctgtatctggcgccgttgacgctcgggatcggcgtggtcgcgctggtggtgctggttcgccacccgctgatgccggtgtatatcgatattctgcgcaaagttgtgggttactaacgattcctttgccggatggcggcttcgccttatccggcctacaaaatatgggatttgatgcccaatagcgctgaggcgctggcttgaccgcttagtagctcgtctgttttgccttgccacgcaatgcgtccgtcggcgacgacgattgaccggggcgcaatccgcgccgcatcttccacgctgtgcgagaccatcaacagcgtgagctgtcgctcgcggcagatatcgctgaccaacgtcagcatctcctggcgcagcgcgggatcgagcgcggagaacggttcatccagcagcagcaccggctgttcacgtaccaggcagcgcgccagcgctacccgctgacgctgcccgccggacagttcgcccggtaaacgcgccatcagactctcaatgcccatctgacgtgcgatagcgtcccgtttttcccgctggctggcgttgagcgttaacccagggtttagccccagaccgatattttgctgcacattcaggtggctgaataaattattctcctgaaacagcattgagaccggacggcgtgagggcggcgtaagcgtatggtcttcgccggcaatcagtagcgtaccgctggcaggcgcaagaaaaccggcaattaaattcaacaacgtgcttttccccgcgccgctggggccaagaatcgccacctgctcgccgcgttctaccgccagcgtaaaacgcatcggcaaatgatggtaaagccaggtgatatcaatcagttttagcatgtcggcccggtagtttctctatgagggtaaataacgtaaaacagagcagcaacagtatcagcgcggtcaccgcgccgtcctggctgcggtaggagccgatctgctgatacagataaaacggcagcgtgcggaaattgtcattgccgaaaagcgcgacgacgccaaaatcaccgatagaaagtacgcaggcaaacgccagcgcctgcgccagcggacgtttcagcgcccgcagttccacgacctttaaccgcgaccagccttcaattcccaatgactggcacagcattccataacgggcggtaatatcgcgcattgggttttccaggacttttagcgcgtaggggattgccatcagcgcattggtgaaaatcacgatgccgtcggcggattccggtaagccaacgctgttattgagcagtaaaaagaagcctgtcgccagcacgatccccggcatcgcgaggatcaacattccgctgagttccagcgtttgtccggcgaatagttgctggcgttggtgtagctcgcggctactccacagcagcatcatggtcagcaccacacacagaacgcccgccgccagcgcaatgcgtagcgatgtccagacagcctgccacagaatgggttgcgccagcacttccggcaggctgcggttgacgccatcgaccaccacggcgaccagcggcggaagcagcaatagtagcgccagcacgattaataaggcgtccgtcagacggctgtggagacgatcgtcaggatcgcgccagccctgcgtcagcgtcatccccggcgcaatcgctttgctcaaccgttgacttagcagtaccagcgccaggcagcagaccatctggattaatgccagcatcgccgcgcgggcgggatcgtagtcataactgagcgcctgaaagatagccagttcgatagtggtggcctgcgggccgccgccgagcgacaggaccgttgcgaaactggcgaagcagagcataaaaatcagcgccgcgacgggcggaatttggcggcgcagccacggccattcgacaaaacggaaaaaatgccagccgcgcataccgagctgggcggcgagctggcgctgctcgccgggaatgctttccaacgattgcagcaacaaacggctcgccattggcagattaaaaaagacgtgcgccagtaaaatgccctgcaagccgtagggggagaatgtccactgaagccccagcatctgccacagcgaggccagccagccctgacgtccatacacgctaagaatgccgaacacggcaaccagtaccggcagaatcagcgtcatggcgcacagacgcagcagcgccagacgtccaggaaaacggcgtcgataaagcgcgcgggcgagaaaaaccgccgggaccacagacagcactgcggacagaaacgcctgccagaatgagaagcgcaccacatgccacagatagctatcccgccagagtgtcgaccacgcgcccgacggcgcgttcagccaaagcgccagaaaggccgccagcgagacggttatcatcagcgcggcggcgcacagccccggaatcagccagccgggaattaacggctgacggcgcgttgccattcgctaatccatgcctggcgttgtgctgccacttgttgcggcgtgaattccagcgttgtggcgggtttggccaatgattcaaaccctgcgggtaaggcgacgtccgctaccgggtacatccagttgccggtgggtatggcgttctgaaacgccggagaaaccataaatttgaggaatttctccgccagttccggctgcttactggcgacggtacgcgccgcgacttctacctgtaagtaatggccttcgctgaagttcgcggcggcgtaattgtccttcttctcttcaataatgtgatacgccggagaggtggtgtaactgagcaccaaatcgctttcacctttcagaaataaaccgtaggcctcgctccagcctttcgtcaccgtcaccgttttggccgccagtttttgccaggcctgcggcgcgttatcgccataaactttgcgcatccacagtaacagccccagccctggcgtactggtacgcggatcctgataaatcacccgccatttttgatcgctctcgaccagttctttcaggcttttcggcggatttttcagcttgcttttatcgtagacaaaggcgaaatagccgtaatcgaacggcacaaatgtgtcgtttttccagccgccgggcaccttgaccgcctcattcgccacgccgcttttggcaaagagtttagtttgcgtggccgcctccagcagattattgtccagccccaacaccacatcggctttgctgttcttcccctccatccgcaggcggttgagcagcgaaacgccatcctccagcgccaccagtttcagctcgcagttgcaatcggcttcaaacgcttttttcaccgccgggcctggcccccagtcggcggcgaacgagtcgtaggtatagacggtgagaacgggtttggcgaaagcaggcgccgcgcacaggagtaaaagcggaagatatttttttaacactttgcacctcagttaaagagtggcaaaggacttgagaggtagcctcaaatcccttcgccggcattatccggatcaggttcgacgggtattttctcagcgcgcgcatgagcgcggcaccccgttgagttcggcgttagtgtagtgattttgttgccgggcagcaatcaagagctggcgttaaggatctggcggcgcaaaccacgccgatttaaaatcaaaccagccgagggtattcatgcgcagcccgcgcatactgcgttgtccctggataatcagccagtggtggatcaacggcacaatcgctttgttggccagcagttgctggcaccagttcgccaggttcatctcgccagcgcgccactgcgcggcgtcgtcctgccagtcgcgcggaatgcagttctgcaagagcggtacttcgcacaggtgcgcgaacagcgagaaatccagcggcagcgtaaagttagcgctattgagccagatatcgctttcgatctcgccggcgtgccattgatcgtagtcgatctcctgaatatgcagatgcacctgatgttcagccagaagcgcgctcatgatacgggcgataacccggtgctcaatgtgttcgcgatagaaggtcagcgtgagggtttccagcccggcgggtttttcgcccgggcctggacgggcgtggtgccagcgcggtaaaagcccataggccgggaaccagagctgctgtagcggttcatcggcatgatagagtaaattggtgggggagaggacgtggcttacccattctctgacctgcggatgcgcgccgcgcggcgttctggcgtcgaatagcaggtaatagcacccctcttccagtcggctttctatcgctttttcaccgccttgtattggcccttccagcatcaagccgcaggccggttcttcactgatatccggcagtacccagacgttcacttcgtctatcaacgcccgatagccgaagtaatcatcaaaggcgagtatcttgagctggtttggcgtattacgccgcacggcataaggcccggtgccgatagggtggctggcgaaattagccagcgtttcccactcccgcggcaaaatcatcgccgggacctggcccagcagccacggcaaccagcgatccggctgggaaagatgaatatccagcgtccacgcggtaggggagtctatctttgtgatgtgcgagtaaagcggaagcgtattgatacgcgtcagcgaggcgatgacatcttccatctccagctcgcggccatgatgaaaatgaatgccggggcgcaggtagaagcgccacagtaaaggggaaatttgctgccagtggtgcgcaatgtccgcttccagttccccgttttcctcatttacccgcgtgagcgaactgaaaatttgccgggcaatatgagtttccgagcgacgtaatgcggttcccggcaggagattgtgcatcggacgatagtaaagaacccgcagaatatgccgcccctggcggaagctgcgtcccagatgggaaatcagcatttgcctgacagcgcttttatcgccgaccagttgtaccagttgatcgattcgatcttgttccagcaggtcttccgcccgctgctgttgcagcgccagtccggtatacaggaacgtcagacgcgaacgctttccgcgtccgacctcggcttcccatgttagccaaccgcgcgcctgcatcgtatttagcagcgtacgcatatggcgacgcgaacagttcagcagatccgccagctcattaagcgtggtgtcttgcgttttaccgtcacaacattgccagagacggataaattgttgttgcaggcgacctgagggcataaaaggggaactccgatgaaaaactcagcaattttattatccctatattaggccaataatatctttcgatgaagcaagaggaagaggtcactatgcgccagttctggttgagatattttgccgcgacggaaaaaacgtcctggctggcttgcctgagcgcgccgcagcgcttaaaaatgctcgcggaactgatgcagtgggaggcgaccgattgaagccaattgcagacatcatgtgtgactgagtattggtgtaggcgatagcctaaaatcacccgccagcagataatatctgctggcttttttatttcggctgtttctggatgacgacgatgggacggcgtctcaacgggatttctgcggcggtttctgtggtcacgcgggtgatgaccgggcgagtaaaagacgtataaaaaatgccggaatatccccggcatgagcgactgatgagtaaccaggcgcttgatggcgctacgcttatcaggcctacagaatatagtggcaacctggtgatattgcataccctgtaggcccggtaaggcgtgaaaggttaccgcataaatgccggttgtttattttcgtactcggcaatcgcgtcttcgtgctgcagcgtcagcccgatgctgtccagaccgttcaacatgcagtggcggcggaagtcgtcgattttaaaactgtaggtcttatcgcctgctttcaccacctgtgcttccagatccacttcaaatttaatgcccggattggctttcaccagcgtaaacagctcatcgacctgttcgtcgcttaacttcaccggcagcagttggttattgaaactgttgccgtagaagatgtcggcgaagcttggcgcgatcaccactttaaaaccgtaatcggtcaacgcccacggcgcgtgttcgcgtgaagagccgcagccaaagttttcccgcgccaacagtatcgacgcgccttgatattccggaaagttcaacacgaattccggatttggctgttggcccttttcgtccaggaaacgccagtcgttaaacagatgggcgccaaaaccggtgcgcgtaaccttctgcaaaaactgtttagggataattgcatcggtatcgacgttggcggcatccagtgggacaaccaggccggtatgctgggtaaatttctctgccatggtagtttccttatttgatgctgcgaatatcggcgaagtggccggtaacggcggcagcggcggccatcgccgggctgactaaatgcgtgcgacccccgcggccctgacgaccttcaaagttacggttgctggtggaggcgcagcgctcgcccgggttcaggcggtcattattcatggccaggcacatggaacagcctggtaagcgccattcaaatcctgcttcgataaagatcttgtccagaccttccgcttccgcctgcgctttcaccggacctgaacccggcaccaccagcgcctgcacgccaggcgcaactttgcgccctttggcgacttccgccgccgcgcgcaaatcttcaatacgcgaattggtacaagagccgataaagactttatcaatagcaacgtctgttaacggtacgcccggctgtaagcccatataagccagcgctttttcggcgctggcgcgctcaaccggatcgctaaaagaggcgggatcggggatgatgtcggtgacggaaatcacctggcccggattagtgccccaggtcacctgcggcgcgatctcttctgctcgcagggtgacgacagtatcaaaggtcgcgccgtcatcggttttcagcgttttccagtactcgacggcttcgtcaaaatcgcggcccttcggcgcgtgcaaacgcccttttacgtagttgaaagtggtttcatccggggcgaccagaccggctttggcgcccatctcaatcgccatattgcacagcgtcatgcggccttccatactcagcgcgcggatagcgtcgccgcaaaattcaaccacgtgtccggtgccgccggcgctaccagttttaccgatgatcgccagcacgatgtctttggcggtaatgcccggtgcggcgttgcccgtgacttcaatcttcatggttttagcgcgcccctgtttcagggtttgcgtcgccagtacatgttctacctcagaagtgccgatgccgaaggccaacgcgccaaacgcgccgtgggtagcggtgtgggagtcgccgcagacgatggtcatacccggcagggtaacgccctgttccggccccatcacatggacgatgccctgatatgggtgattcaggtcatacagctcgacgccgaactcgttacagttcttaatcagctcttgcatctggatacgcgccatttcaccagaagcattaatgtctttagtctgcgtcgagacgttgtgatccatcgtggcgaaggttttccccggctgacgtaccggacgatggtgcgcgcgcagaccgtcaaacgcctgcggcgaggtcacttcgtgtaccaggtggcgatcgatgtacagcagcggcgtttcgtttggcgcctcaaagaccacgtgggcatcaaataatttttcgtataacgttttggccatgattacaccccttctgcgacatagcgggcgataatatcgcccatctcatcggtactgactgcggcagcgcccctggctaaatcgctggtgcgaaccccctcttctaatgcgcgattgatcgcctgttcaatggccgttgccgcctcatcggcatccaggctgtagcgcagcagcagcgccagcgacaggatctgcgcaattgggttggcgatatttttcccagcgatatccggcgcggagccgccagccggttcatacaggccaaactcttgctcgttcaggctggcggagggcaacatccccattgagccggtgatcatggcgcattcgtcggacagaatgtcgccgaacaggttagagcacagcaggacgtcaaactgcgacgggtctttaatcaactgcatggtggcgttatcgatatacatgtgcgcgagttccacatcgggatacgctttcgcgacatcattgacgatctcacgccacaggatagagctttgcagtacgttggctttatctatagaggtgactttacggcggcgtttacgcgccgattcaaaggcgatacgggcaatgcgctcgatctcaaagcggtgataaacttcggtatcaaaggctttttcgtactgaccgctgccttcacggccttttggctgtccgaaatagatcccgccggtcagctcgcgcacgcacaggatatcgaaaccgttagcggcgatatcggcgcgcaacgggcaaaatgcttccagtccctgatacagtttcgccggacgcaggttactgaataatttgaaatgtttgcgcagcggcagcagggcgccgcgctccggctggctttccgggggcaaattttcccatttcgggccgccgacggagccaaacagaatggcatccgcctgctcacacccttcaacggtggctttcggcagtggatgaccatgattgtcgatagcaataccgccgacgtcatagcggctggtggtgatacgcatatcaaaacggctgcgtaccgcatccataactttcagggcttgcgccatgacttccgggccgataccgtcgcccggcagtacggcaatatgatagttcttcgacattacacggtttccttgttgttctctttattttgagctttgcgttgcaattctttttcaacttcggcggcgcgccagatattgttcagtacgtgtaccatcgctttggcggaggattcgacgatatccgtcgccagcccgacgccgtggaagcggcgaccatgatggttcacgacgatatcgacctgacccagcgcgtctttgccctggcctttggcgttcaggtcgtatttaaccaactcaacgtcgtagccagtgatgcggttaatcgcctgatagatggcgtcgaccgggccgttgccgttcgccgcctcggccttgatctcttcaccacaggccagcttcacggaagcggtggcgatatcgctggagccggactgcacgctgaagtaatccagacggaaatgctctggttcttcttgctgtttattaataaacgccagcgcttccaggtcatagtcgaacacctggccttttttgtccgccagcttcaggaacgcgtcgtacaggtggcccatgttgtagtctgtgtccttgtaacccatctcttccatgcgatgtttcacggcggcacggccagagcgggaggtcaggttcagctgtatctggttcagaccgatggactctggcgtcatgatttcatagttttcgcggttcttgaggacgccatcctggtggatgccggaagagtgggcaaaagcgccgctgccaacaatcgctttgttggccgggatcggcatgttacagatctggctgacggtctggctggtgcgccagatttcgtggtgattgatgttggtgtgtacgtttatgatgtctttgcgcactttaatcgccatgatcacctcttccagcgcgcagttaccggcacgttctccgataccgttcatcgcgccttcaacttgacgcgcgcccgcatgtactgccgccagcgagttgcctaccgctatccctaaatcgtcgtgggtatgaacggagatgatagctttgtcgatattggggacacgttcatacagaccggaaatgattcccgcgaactcaaacggcatggtatagcccacggtatcgggaatattgatggttctcgcgccggcgtttatagcggcttccaccacgcgcgccagatcgtcaacaggcgtccggccagcatcctcgcaggagaactccacgtcatcagtgtaattacgcgcccgcttaaccatgtataccgcgcgttcgatgacctcatccagcgtgctgcgcagcttggtggcgatgtgcattggcgaggtggcgataaaagtatggatacgaaacgcgtcggcgaccttcagcgcctgtgccgcaacgtcgatgtctttttctacacaacgcgccagggcgcaaacgcggctgtttttgatggtgcgggcgatggtttggacggattcaaaatcacccggagaagagaccgggaagcccacttccatgacatcgacacccatgcgctcaagggccagggcaatctgcagcttctctttcgcgctcaggctggcctgtaacgcttgttcgccgtcgcgtaaggtcgtatcaaaaataatgacttgctggctcatgatgtggtccttgtctccaggggcgccttgcgtcaggcataaaaaaacccgcacaacggcgcgggttttgtttgacttcgagctgacttaatgttgaatgccgcccaccggtctaccgcgcacaataaatgcgttgagtagtagtagcccagtgaaacgaacgatatatgacattaattctagctccagcgaatgcgttatgcttttagtggtactggatatgccgtttaatgtcaactctattttctgtcgccattgcattttgttgacgatatccggatacgtactttagctaattgtgctgggctgcgcgtccaataaaggataaaagaacgagtggacattcatacttttcattgtttgaaatatttaggcatttttgtttgcaaattggttaggggaatggcctgttaaaggtatgctaaaggtttggtttatctttttgatttgttttatattttaacaaataaccttgtttgcttaatggataaggataaagttattgataaattaatgttaactttttagctattaataatataaacatttaattgaaacttaaatgatcattcacttggtgtatgattgtgtattcgccatagttatggttatattgcttgcgtaatttaaacattatgaatcgcaatggtgtgactcaggacatattacgcttgcgctggcattctatttgtctctgtcagcgtctttatgttttccgaattttaacgctttccctttttcttattttatatgcatggtaaatcatattttcaggaattatttctgccttcagccagaaaaagggagttaagcgtgacagtggagttaaatatgccagaggtcaaaaccgaaaagccgcatcttttagatatgggcaaaccacagcttcgcatggttgatttgaacctattgaccgtgttcgatgcggtaatgcaagagcagaatattacgcgcgccgcccacacgctgggaatgtcgcagcctgcggtcagtaacgccgtagcgcgtctgaaggttatgtttaatgacgaactttttgttcgatatggacgaggaattcagccgactgcccgtgcatttcagttatttggttcagtccgtcaggcgttgcaattggtgcaaaatgaattgccgggatcggggtttgagccgaccagcagcgaacgtgtattcaatctttgcgtgtgcagtccgctggataatatcctgacgtcacagatttataatcgtgtagaaaaaattgcgccaaatattcatgtcgtttttaaagcgtcgttgaatcagaatactgagcatcagttacgctatcaggaaaccgagttcgttattagttatgaagaattccgtcgtcctgagtttaccagcgtaccgctatttaaagatgaaatggttttagtcgccagccgaaaacacccgcgtattagcggcccgctactggaaggcgatgtttataatgaacaacatgcggttgtttctctcgatcgttatgcgtcatttagtcggccgtggtatgacacgccggataaacagtcgagcgtggcttatcagggcatggcgcttatcagcgttctgaacgtggtttcgcagacgcatttggtcgctattgccccgcgctggctggcggaagagtttgcggagtcgctggagctgcaaatactgccgttgcctttaaaactgaatagccggacatgctacctttcctggcatgaagcggctgggcgtgataaagggcatcaatggatggaagatttattagtctctgtttgtaagcgataaaaccgggcagaataaatcagaaacaaattctggtttattctgctttttagcgtatgtcaaaaattttatgctgaattaacggtgagcgattcttttcgtcgctgtgaaaaatagatgaattgctgtaagtctgcatttataagcgattatttattacctggtgtgattcagacggagtatttctccatttcttctcttcttgcctcctgattattctaaccttccccatctttacgtcattccacccaattgccaggcgtgatagcgagcggttaaggtgtccgtcaaaccgtaatgacaggtataaagtggaggcaagccgtggagatgttgtctggagccgagatggtcgtccgatcgcttatcgatcaaggcgtaaagcaggtgttcggctatcctggaggcgcagtgcttgatatttatgatgcgctacataccgttggagggatcgatcatgtgctggtgcgtcatgagcaggccgcggtgcatatggcggatggcctggcgcgagccactggcgacgttggcgtggtgctggtgacttccggaccgggagcgaccaatgcgattacagggattgctacggcctatatggattccattccgctggtgattctttccggccaggtcgccacctcattgattggctatgatgcctttcaggagtgcgacatggtggggatttcccgaccggtggtcaaacatagcttcctggtcaaacagacggaagatattcccctggtgcttaaaaaggccttctggctggcggcaagcggacgtcctgggccggtggtcgtggatctgccgaaagatattttgaatccggcgaaaaaaatgccgtatgtctggccggaaacggtcagtatgcgctcttacaatcccacaacatcaggacataaaggacaaattaagcgtgccttgcaaacgctggcgtcggcaaaaaagccggtggtctatgttgggggaggggcgataagcgcggcctgctatgcgccgctgcgccacatcattgaaacctttaacctgccggtggtctcttcattaatgggactgggcgcgtttcctgctactcatcgccagtcgttaggaatgctgggaatgcatggcacttatgaagccaatatgaccatgcataacgccgacgtgattttcgctgttggcgtacgatttgacgaccgcacgacgaataatctcgctaaatattgtccgaacgcgacggtattacacatcgacattgacccgacgtccatatccaaaacggttaacgctgatatcccggtggtgggcgatgcacgcctggtactggaacaaatgctggagctactggcgcaggatgcgccgtctcagccgcaggatgatattcgcgactggtggcagcagatagagagctggcgcgcccgtcagtgcctgaaatatgacgcggaaagcgaaagcattaaaccccaggcggtgattgaaactctctggcgtctgacgaagggtgatgcgtacgtgacgtccgatgtaggacaacaccagatgtttgccgccctctactacccgttcgataagccacgtcgctggattaactctggcgggctcggcacgatggggtttggcctaccggctgcactgggcgttaaaatggccctgccgaaagaaatggtggtctgcgtgaccggcgatggcagtatacagatgaacattcaggagctgtcgacagccttacagtatgaactgccggtactggttctgaacctgaacaaccgttacctggggatggtgaaacagtggcaggatatgatctattccggtcgccattctcagtcttatatgcagtcgttaccggattttgtgcgcctggcggaagcatatggccatgtcgggctgcagattaaccgtccggatgagctggaaagtaaactcagcgaagcccttgagcatgtgcgtaataaccgactggtgttcgtcgatgtcaccgttgatggcagcgagcatgtctatccgatgcagattcgcgggggcgggatggacgaaatgtggttaagcaaaacggagaggacctgatgatgcgccggattttatcggtattactggaaaacgaatctggggcgttatcgcgggttatcggcctcttttcgcaacgcggatataatattgaaagcctgaccgttgcgccgacagacgatccgacgttgtcgcgcatgactatccagacggtaggcgatgaaaaagtgcttgagcaaattgaaaagcaactgcacaagctggttgatgtgctgcgcgtcagcgagctgggacagggagcgcacgttgagcgggaaatcatgctggtgaaaatccaggccagcggctacggacgggaagaggtgaagcgtaatacggaaattttccgtggtcagattattgacgttacgccaacgttgtataccgttcaactggcgggcaccagcgataaactggatgcttttctggcctcgctgcgcgatgtggcgaaaattgttgaagtggcgcgttcaggcgtcgtcgggctttcgcgcggcgataaggttatgcgctgagcagattcgccggatgacgacgcgcttgcgttttatccggtctacaggctgatatctggcccaggtccgataagcgtagcgccatcaggcaggtttgccggatatcagccaacaggaattatcgcccaacccaatatcatcggttgggcttttttttgcgaaatccgtggtaacccggaataaaagcggttgccggagtgatcaaactgcgcttagatgttaacgattttaacccatgccgacataaaggttatggtttgtacaatttacacaaggggcaattgtgaaactggatgaaatcgctcggctggccggtgtctcgcgcacaactgcaagctacgttataaacggtaaagcaaagcaataccgcgtgagcgacaaaaccgtagaaaaagtcatggcggtagtgcgtgagcacaattaccatcctaacgctgtggctgccgggctgcgtgctggacgcacacgttccattggtctggtgatcccggaccttgaaaacacgagctacacccgtatcgcaaactatcttgagcgccaggcacgccagcgtggctaccaactgctgatcgcctgttctgaagatcagccggataacgaaatgcgctgcattgagcaccttttgcaacgccaggtggatgcaatcattgtttcaacttcgttaccgccggagcatcccttctatcagcgctgggccaacgatccgttccccatcgtcgcgctcgaccgcgcgctggatcgcgaacatttcaccagcgtggtcggcgccgatcaggatgatgccgagatgttggcggaagagctgcgtaaattcccggcggaaacggtgctttatttgggcgcgctgccggagttgtccgtcagtttcctgcgcgagcaggggttccgcaccgcatggaaagacgatccgcgggaggtgaatttcttatatgccaacagctatgagcgcgaagccgccgcgcagctgtttgagaaatggctggaaacgcatcctatgccgcaggcgctctttacgacatcattcgcgctattacagggcgtgatggacgttacgctgcggcgcgatggaaaactgccttcggatttagcgattgcgacctttggcgatcatgagctgctggattttctgcaatgcccggtactggcggtggcgcagcgtcatcgtgatgtcgcggaacgcgtgctggagattgtgctggcaagtcttgatgaaccgcgtaaaccgaaacccggcttaacgcgtattcggcgaaacctgtatcgtcgcggcattctgagccgtagctaaaggaccggcggtaaaagactctctcttctgccgccgtcaaacaaatgcgtatcagtaaaaatatcccttaaataattaagattattccttaaaattatccgaaaattcttttttattacctttcttttgtccgaaatcgtccatattccactaattaagacgtaacgagtcttttcctttgtattgttttgttacaagcaggcaagaaatcgtcgaattaacagccactttttgtctttggcgcgacagtcgcttgtaggcgctggtatagcaggcgccgcacacgttaaacaggcactgttaacacggtgcaatatgtcctaaaatgccgctcgcgtcgcaaactgacactttatatttttctcggattatattgagtccgttttaaacggcggtgggtctttggtttttttcttacaaatattcataacgttaatttggcttgcgcgctgggcggaaattaatcaacgcagatattcgccgtaaacattggcttttttacttcggtaagcgttgtgacttgcttgacaagcttttcctccgctccgtaaactccttcgagtgggaatttgtgggataaagtggtaagaaggggtgagactggcatgttccggggggcaacgttagtcaatctcgacagtaaagggcgcctgaccgtgccgacccgttatcgggagcaactgatcgagagcgctaccggtcaaatagtatgtaccattgacatccatcacccatgcctgctgctttaccccctgcctgaatgggaaattattgagcaaaagttatctcgtctgtcgagcatgaacccggtagaacgtcgcgtacagcgtttactgttgggccatgccagtgaatgtcagatggatggtgcaggtcgattactgatcgcgccagttctgcggcaacatgccggactgacgaaagaagtgatgctggttggacagttcaacaaatttgagctgtgggatgaaacgacctggtatcaacaggtcaaggaagatatcgacgctgaacagtcagctaccgaaacgttatcggagcggctgcaggacttgtctctataagatgatggaaaattttaaacacactacggtactgttggatgaagccgttaatgggctgaatattcgtccggatggtatctatattgatggcacatttggtcgcggcggccactcgcgcctgatcctctcgcaactgggcgaagaggggcgcttgctggcgatcgatcgcgatccgcaggcgatcgccgttgcgcagaccattaatgatcctcgcttctccatcattcatggacctttttccgcgctggctgattatgtcgccgagcgcgagcttaccggcaagattgacgggatccttctcgatcttggcgtctcttctccgcagcttgacgatgcggagcgcggtttttcatttatgcgcgacggtccgctggatatgcgaatggacccgacgcgcggccagtctgccgccgagtggttacaaacggcggaggaggcggatatcgcctgggtgctgaaaacattcggcgaggagcgttttgccaaacgtattgctcacgccattgttgagcgcaatcgcgaacagccgatgacccgcaccaaagagctggcggaagtggttgcggcggcgaccccggtaaaagacaaattcaaacatcccgcgacccgtaccttccaggcggtgcgcatctgggtaaacagtgaactggaggagatagagcaggcgctaaaaagctcgctcagcgtactggcctcaggcgggcggctttcaatcatcagtttccactcgctggaagaccgtattgtgaaacgctttatgcgtgagcaaagccgcggtccgcaggtaccggcgggattaccgatgacggaagcgcagctcaaaaaactgggcggtcgtgagttacgagcgttaggcaagttgatgccgggtgaaaaagaggtagctgaaaatcctcgggcccgtagttcagttctgcgtatcgcagagaggacgaacgcatgatcagcagagtgacagaagccctaagcaaagttaagggatcgataggaagcaacgagcgccatgccttgcctggcgtgatcggtgacgatcttttgcggttcgggaagctgccactctgcttgttcatttgcatcattttaacggcggtgacggtggtcacgacggcgcaccatactcgtttactcaccgctcagcgtgaacaactggttctggagcgcgatgcattggacattgaatggcgcaacctgatccttgaagaaaatgcgctcggcgatcacagccgggtagagcggatcgcaacggaaaagctgcaaatgcagcatgttgatccgtcccaagaaaatatcgtagtgcaaaaataaggataaacgcgacgcatgaaagcagcggcaaaaacgcaaaaatcgaagcgccaggaagaacagaccaacttcatcagttggcgttttgcgttgctgtgcggctgtattttactggcgctggtttttttacttggacgcgcggcgtggctacagattatcgccccggatatgctggtgcgtcagggcgatatgcgttcgctgcgtgttcaggaagtctccacctcacgcggtatgattaccgaccgttccgggcgtccactggcggtcagcgtaccggttaaggcgatctgggccgacccgaaagaagttcatgacgccggcggcatcagcgtcggcgatcgctggaaagcgctttctactgcgctcaatattccgctcgatcagctctccgcccgtatcaacgccaacccgaaagggcgttttatttatctggcgcgccaggtaaatcctgacatggcggactacatcaaaaaactcaaactgccggggattcatttgcgtgaagaatcacgccgctactacccgtcaggagaagtaaccgctcacctcatcggttttaccaacgttgacagtcaggggattgaaggcgttgaaaagagctttgataagtggcttaccggtcagcctggcgagcgaatcgtgcgtaaagaccgctatggccgcgtgattgaggatatctcctccactgacagtcaggcagcgcacaacctggcgttaagcattgatgaacgcttacaggcgctggtttaccgcgaactgaacaacgcggtggcgtttaacaaggcggaatccggtagcgcggtgctagtcgatgtcaataccggtgaagtactggcgatggcgaatagcccttcctataaccccaacaaccttgccggtacgccgaaagacgcgatgcgtaaccgtaccatcaccgacgtgtttgaaccgggttctacggttaagccgatggtggtgatgactgcgcttcagcgcggtatcgtcaacgaaaatacggtgttgaataccgttccataccgaattaacggccacgaaattaaagacgtggcgcgctacagcgaattaaccctgactggggttctacagaagtcgagtaacgtcggtgtatccaaactggcgttagcgatgccgtcctcagcgttagtagatacttactcacgttttgggctaggaaaggcgaccaatttggggttggtcggagaacgcagtggcttatatcctcaaaaacaacggtggtccgacatagagagggccaccttctctttcggctacgggctaatggtaacgccgttacagttagcgcgagtttatgcaacgatcggcagctatggcatttatcgcccgctgtcgattaccaaagttgatccgcctgtacccggcgaacgcatcttccctgaatccaccgtacgcaccgtggtgcatatgatggaaagcgtggcgctgccgggcggcggcggcgtgaaggcggcaattaaaggctaccgtatcgcgattaaaaccggtacggcgaaaaaagtggggccggacggtcgctacatcaacaaatacattgcttacaccgcaggcgtcgcgcctgcgagtcagccgcgcttcgcgctggtggttgtcatcaacgatccgcaggcgggtaaatactacggcggcgccgtttccgcgccggtatttggtgccatcatgggcggcgttctgcgcaccatgaacatcgaaccggacgcgctggcaacgggcgaaaaaaatgaattcgtaattaatcaaggcgagggaacaggtggcagatcgtaatttgcgcgaccttcttgctccgtgggtggctggactacccgcgcgagaactgcgagagatgacgctcgacagccgtgtggctgcggcgggcgatctctttgtggcagtggtgggtcatcaggcggacgggcgtcgttatatcccgcaggcgatagcgcaaggcgtagctgccattattgcagaggcgaaagacgaggcgagtgacggtgagattcgcgaaatgcacggcgtaccagtcgtctatctcagccagctcaatgagcgtttatctgcgctggcgggccgcttttaccatgagccatctgaaaacatgcgtctggtggcggtgaccggcaccaatggcaagaccaccaccacccaactactggcgcagtggagccagttgctcggcgaaaccagcgcagtgatggggacggtaggtaacggactgttgggtaaagtgatcccgacggagaacacaaccggttccgcagtggatgttcagcatgtgctggccagtctggttgcgcagggcgcgaccttcggcgctatggaagtctcttctcacggcctggtgcagcatcgcgtggcggcgctgaaatttgccgcctccgtgtttactaatttgagccgcgaccatctcgactatcatggcgatatggcgcattacgaggcggcaaaatggatgctttattccacccaccatcacggtcaggcaatcgtcaacgccgatgatgaagttggacgccgctggctggcgtcgctacccgatgcggtcgcggtttcaatggaagggcatatcaaccctaactgtcacggtcgttggctgaaagcggaggcggtggagtaccacgaccgcggagtgacgattcgttttgcttcaagctggggtgaaggcgaaatcgaaagctgcctgatgggcgcgtttaacgtcagcaacttactgctggcattggcgacgctgctggcgctgggctatccgttaacggatttgctgaaaaccgccgcgcgtttgcagccggtttgcgggcgtatggaagtgttcactgcgccaggcaaaccgacggtggtggtggattacgcgcacacgccggatgcgctggaaaaagcattgcaggcggcgcgcctgcactgcgccggaaaattgtggtgcgtctttggctgtggcggggatcgtgacaaaggtaagcgcccactcatgggggccattgccgaagaattcgcggatatcgtcgtggtgactgacgataacccgcgtaccgaggagccgcgcgccattatcaacgatattctggccggaatgctggacgccgggcaggtcagggtaatggaaggccgcgctgaggcggtaaccaatgccattatgcaggcaaaagacaatgacgtcgtgctgattgcaggtaaagggcacgaggattaccagattgtcggcacgcagcgtcttgattattcagaccgcgtgaccgcagcgcgtttgctgggggtgatcgcatgattagcgtaacgctcagcaaaattgccgatgtccttggcgccgaacaccgcggggcggatctcacgctcgatacggtcattaccgacacacggaaagtgacgccgggatgcctgttcgtggcgctgaaaggggaacgctttgatgcgcatgattttgctgataaagcaaaagcgaacggcgctggcgccctgctggtcagtcgtcctctggatatcgatcttccgcaggtgattgtaaaagacacgcgtcaggcatttggccaactggccgcctgggtacgtatgcaggtaccggcgcgggtggtggcgttaaccggttcgtccggcaaaacctcggtcaaagagatgaccgccgcgattcttagccagtgcggaaatactttgtataccgcaagcaattttaacaacgacatcggcgtgccgataacgctgctgcgcttaaaccatgattatgactatgcggtgatcgagttaggcgctaatcaccagggagaaatcgcctggaccgttagcctgacgcgcccggaagcggcgctggtcaataacctggcggcggcgcatctggaaggtttcggctcgctggccggcgtggcgaaagcgaaaggcgaaatctataccggtttgcctgagaacggtatcgcgattatgaatgccgataataatgactggctgaactggcaaagcattattggcgatcgtcaggtgtggcgcttttcgccgaatgcggcaaacagcgactttaccgctgcgaatatccacgtgacgtcacacggtaccgaatttaccctgcaaacgccgatgggcagcattgatgtgctgctgccgttgccggggcggcacaatattgccaacgcgctggcggccgctgctttatcaatggcggtgggggcgacgctggcggcggttaaagcagggctggcggcgttaaaagccgtacccgggcgtctgttcccgattcaactaagtgaaaaccaactggtactggatgacgcttataacgccaacgtcggttcgatgaccgccgcagtgcaggtcctttctgaaatgcccggctaccgcgtgctggtggtaggcgatatggccgagctgggcgcagaaagcgaagcgtgccacctccaggttggcgaggccgcaaaagcggcgggtattgatcgcgtgttaagcaccggaaaactcagtcaggttatcagccacgccagcggcgtcggcgaacattttgccgataaagccgcgctcattgcgcgtttacacgctctgcttcaggagcaaccgatgatgactattttagtgaaaggatcacgcagcgccgcgatggaagatgtggttcatgcgttacaggagaaaggttcatgttagtttggctggccgagcatttggtcaaatattattccggctttaacgtcttttcttatctgacgtttcgcgccatcgtcagcctgttgaccgcgctgttcatctctttatggatgggcccgcgtatgatcgctcgtctgcaaaaactctcttttggccaggtggtacgtaacgatggcccggaatcgcacttcagtaaacgcggtacgccgacgatgggcggcatcatgatcctgacggcgattgtgatttccgttctgttatgggcttacccgtctaacccgtacgtctggtgcgtgctggtggtattgatcggctacggcattatcggttttgtcgatgactaccgcaaagtggtgcggaaagataccaaagggctgattgcgcgctggaaatatttctggatgtcggttatcgcgctcggcgtggcctttgcgctttatctcgtcgggaaagacacgcccgcgacccaactggtggtgccgttctttaaagatgttatgccgcaattggggctgttttacattctgctgtcctactttgtcatcgtcggtacgggtaacgccgtaaacctgaccgacgggcttgatggtctggcgattatgccgactgtcttcgttgccgccggctttgcgctggtggcttgggcgaccgggaacatgaacttcgccaattacctgcatattccgtatttacgccatgcgggcgagctggtgattgtctgtacggcgattgtcggcgcgggattaggattcttgtggtttaacacctatccggcgcaggtttttatgggcgatgtcggatcgctggcgttgggcggcgcgttgggcattatcgccgtgctgctgcgtcaggaatttctgctggtgatcatgggcggcgtctttgtggtggaaactctgtcggtcatcctgcaggtgggttcctttaaactacgcggacagcgtattttccgtatggcgcctatccatcaccactatgaactgaaaggctggccggaaccgcgcgtgattgtgcgcttctggattatttcgctgatgctggtgctgattggcctggcaacgctgaaggtacgttaatcatggctgattaccaggacaaaaacgtcgtcattatcggtctgggcttaaccggactctcttgcgtggacttttttctcgcccgcggcgtgacgccgcgggtgatggatactcgcgtgacgccgccgggtctggataagctgccgcaagaggttgagcgtcacgttggcggcctgaacgacgagtggctcttagcggcggatttaatcgtcgccagccctggtattgctctggcgcatccctctcttagcgctgccgccagcgctggagtggaaattgtcggcgatatcgaactgttttgccgcgaagcgcaagcgccgattgtggccatcaccggctcgaacggcaaaagcaccgtgaccaccttagtgggcgagatggcgaaggcggcgggcgtcaatgtcggcgttggcggcaatatcggtcttccggcgctgatgctgctggatgccgatcgcgaattgtacgtgctggaattatccagtttccaattggaaactacctcaagtttgcaagcggcggcggcaacggtgctcaacgtcactgaagatcatatggaccggtatccgtttggtttgcaacagtaccgggcggcgaaactgcgcgtctacgagaaggcgaaagtgtgcgtagtgaatgccgatgacgcgttgacgatgccggtacgcggggccgatgagcgctgcgtcagctttggcgtcaatatgggtgattatcaccttaatcgtcagcagggcgaaacctggctacgagtcaaaggtgagaaggtgctgaacgtgaaagagatgaagctttccggtcagcataactataccaatgcgttagcggcgctggcgctggcggatgccgtaggtctgccgcgcgccagcagtttgaaggcgttgacgacatttaccggtctggcgcatcgcttccagctggcgttggagcataacggcgttcgttggatcaacgactcgaaagcgaccaatgtcggcagtaccgaagcggcgctaaacggtttgcatgtggacggtacgctgcatctgctgctgggcggcgacggtaagtcggcagacttttctccgctggcgcgctatctgaccggcgatcgtatccgcctgtattgctttgggcgcgatggcgcgcagcttgccgcactgcgtccggaaatcgcccaacagactgagacgatggaagaggcgatgcgtttgctggcgccgcacgttcagccgggtgatatggtgctgttgtcgcccgcctgcgccagcctcgatcagtttaaaaattttgagcaacggggcgatgtctttacccgtctggcgaaggagttaggttgatgcgtttatctctcccccgtctgagaatgccgcgcgtaccaggctttggcctcctggcctggctgtttgcggcgcttaaaggctgggtgatggcttcgcgcgataaagacgccgacagtctgatcatgtatgaccgcacgctgctatggctgaccttcgggctggcggcgattggttttgtcatggtgacgtcggcctccatgccagtcgggcagcgcctggcgaacgatccgtttttgtttgccaaacgtgatgcgctctatatcttcctggcattttgtctggcgatggtcacgctacgtttgcccatgaccttctggcaaaaatacagcacgacgatgctgattgcgtcgatcattatgctgcttatcgtgctggtcgtcgggagctcggttaacggggcgtcgcgctggattgcgctggggccgctgcgtattcagcctgcggagtttaccaagctgtcgctgttctgctacctcgcgaactatctggtgcgtaaggttgatgaagtgcgaaataacctgcgcggctttttaaaaccaatgggcgtgattctggtgctggcggtgttactgctggcacagcctgacctcgggacggtggtcgtactgtttgtcaccacgctggcgatgctgtttcttgccggggcgaaattatggcagttcatcgccattatcgggatgggcatctcggcggtgattctgttaatcctcgccgaaccgtatcgtattcgccgcgttacctcgttctggaacccctgggaagatccgttcggcagcggttatcagctgacgcagtcgctgatggcttttggtcgcggtgagatatgggggcaagggctggggaattcggtgcagaaactggagtatttgccggaggcgcacaccgatttcatcttcgccattattggggaagaactgggttatatcggtgtggtattggcgcttttaatggtatttttcgtcgcttttcgcgcgatgtcgattggccgtaaggcattggagattgaccaccgtttttccggatttttagcgtgttctatcggtatctggtttagttttcaggcgctggtaaacgttggcgcggccgcggggatgctgccgaccaaaggtcttacgctgccgctgatcagttatggcgggtcgagtctgttgattatgtcgacggccattatgtttttattacgtattgattatgaaacgcgtctggaaaaagcgcaggcgtttacacgaggttctcgatgagtggtcaaccgaagcggttaatggtgatggcgggcggtaccggcgggcacgtgttccccggactggccgttgcgcatcatttaatggcccagggctggcaggttcgctggctgggtacctccgatcgtatggaagcggatttagtgccgaagcatggcatcgatattgactttattcggatctccggtctgcgcggtaaaggcgtaaaagcgcttctggcggcgccgctgcggatttttaacgcctggcggcaggcgcgggcgatcatgaagcggtttaagccggatgtcgtgctgggaatgggcggttatgtttccggccccggcggtcttgccgcctggtcattgggtattccggtcgttttgcatgagcaaaacggtatcgccgggctaaccaatcagtggctggccaaaatcgcgaccacggtgatgcaggcgtttcccggtgcgttcccgaacgcggaagtggtgggtaacccggtgcgtaccgacgtactggcgttgccgttgccgcaggtgcgtctggccggtcgtgacggcccgattcgcgtgttggtggtcggcggttctcagggggcgcgagtcctgaaccagacgatgccgcaggttgccgccagactgggcgatacggttacaatctggcatcaaagcggaaaaggcgcgcagctcacggtagagcaggcatatgccggggcgggacaaccgcagcataaggtaacggaatttatcgatggcatggccgccgcctatgcgtgggcggatgtggtggtatgtcgttccggcgctttaacggtgagcgagatcgccgccgccgggttaccggcgatattcgtgccgtttcagcataaagacaggcagcagtactggaatgcgctgccgttagaaaacgccggcgcagctaagatttttgagcagccgcagtttactgtagaggctgtcgccgacaccctggcggggtggtcgcgcgaggcgttgttaaccatggcggagcgtgcccgcgcggtatccattccggatgctaccgagcgcgtcgccagtgaagtcagccgggttgcccggacataatttgtggcggtgccttttgcatcgcagggtttttctaccctcaataatttgggttgcaggcaagccaacgcatctgcaatttgaagtatggcgggtattggagttaatggcgtaaagaatgaatacacaacaactggcaaaactgcgttccatcgtgcccgaaatgcgtcgcgttcggcacattcactttgtcggcatcggtggtgctggtatgggcggtattgccgaagttctggccaatgaagggtatcagatcagtggttccgatttagcgccgaatccggtgacccagcagttgacgagcctgggggcgacgattttctttaaccatcgtccggaaaatgtgcgtgatgccagcgtggtcgtcgtttccagcgcaatttccgcggataacccggaaattgtcgcggcgcatgaagcgcgtattccggttattcgccgtgcggaaatgctggcggaactgatgcgttttcgccacggcatcgccattgccgggacgcacggaaaaaccacaacgaccgcgatggtgtccagtatttatgccgaagcggggctggacccgactttcgtgaatggcggattggtgaaagccgcaggcgttcatgcgcgtctgggccatagtcgttacctgattgccgaggcagatgagagcgacgcatccttcctgcatttgcagccgatggttgcgatcgtcaccaacatcgaagccgaccatatggatacctatcatggcgactttgaaaatttaaagcagacgtttattaacttcctgcataacctgccgttctacggtcgcgcggtaatgtgcgtcgacgatccggtcatccgcgagttgctgccgcgggtggggcgtcagaccacgacgtatggctttagcgaggatgctgacgtccgcgtagaagattatcagcagatagggccgcaggggcactttacgctgttgcgccagggaatgccggatctgcatgtcacgttgaatgcgccgggtcgccacaatgccctgaatgccgccgcggcagtggcggtagcgaccgaagaaggcatcgacgatgacgctatcctgcgcgcgctggaaagcttccaggggaccgggcgtcgttttgacttcctcggcgagttcccgcttgagccggtgaatggtaaagccgggacggcgatgctggtggatgactatggacatcatccgaccgaagtggacgccaccattaaagctgcgcgagcagggtggccggataaaaacctggtgatgctgtttcagccgcatcgttacacgcgcacgcgcgatctgtatgacgatttcgccaatgtgctgacccaggtcgatgcgctgctgatgctggacgtttacccggcgggcgaagcgccgattccgggcgcggatagccgttctttatgtcgcacgattcgtaatcggggaaaaattgacccgattctggtttccgatccggctcaggttgcgacaatgttagcgccggtgctgacgggtaacgacttgatattagtgcaaggcgcaggaaatgttggcaaaattgcgcgttacttatctgaaatcaagctgaagccgcaaatccaggaggaagagcaacatggctgataaaatcgcggtcctgttgggcggaacctctgcggagcgggacgtttcgttaaattccggcgcggcagtgttggccgggttacgtgaaggcggtattgatgcgcatcccgtcgatccgcaagaggtcgatgtcgcgcagcttaaagcaatgggctttcagaaggtctttattgcgttgcatggccgcggcggtgaagatggcaccttacagggaatgcttgaactgctcggcctgccttataccggcagcggcgtgatggcctcggcgctttccatggataaactgcgcagtaaattgctgtggcagggcgcaggcttaccggttgcgccgtgggtcgcgctgacgcgcgctgagtttgaaaaaggccttagcgaagaacaaaaagcgcgaatttcggcgctgggtttaccgctgatcgtcaaacccagccgtgaaggctccagcgtcggtatgacgaaagtagtagaagaaaatgctttacagggtgcgttatcattggcttttcagcatgatgacgaaatactgattgagaaatggctgtgcggtccggaatttacggtggcgatagttggcgaagaaattttaccgtcaattcgtatccaaccggcaggaaccttctatgattatgaggcgaagtatctctctgatgagactcagtatttctgccctgccggtttagaagcgtcccaggaagccgcgctacagtctctcgtcctgcaggcatggaaagctttaggctgcacgggatgggggcgtattgacgtcatgctggacagcgatggtcagttttatctgctggaagccaatacttctccggggatgaccagccatagtctggtgccgatggcggcgcgtcaggcgggaatgagcttctcgcagttagtggtacgaattctggagttggcggactgatatgtcgcaggctgcgctgaacacgcgaaacagtgatgaagagacgccttcttcacgccgcaataatggaacgcgtcttgcaggaatattattcctgctgacggtactgtgcaccgtgtttgttagcgggtgggtcgtgttagggtggatggaagatgcgcagcgtttaccgttatcaaagctggtattaaccggcgagcgtcactacacgcgtaacgatgatatccgtcaggcgatactggctctgggcgcgccgggaaccttcatgacgcaggatgtgaacattatccagagccagattgagcgtttgccgtggattaaacaggccagcgtcagaaaacagtggcctgatgaattgaagattcatctggttgaatatgtgccgattgcgcgttggaatgatcaacatatggtcgatgctgaagggaacaccttcagcgtgccgtcagaccgcatcggcaaacaggttttacccatgttgtacggcccggaaggcagcgcgagtgaagtgttgcagggataccgcgagatggggcaggtgctggctaaggataaattcactctaaaggaagcggcgatgaccgcacgtcgctcctggcaattgacgcttaataacggcattaagctcaatctcggcaggggcgatacgatgaaaaggttggctcgctttgtagaactctatccggttttacagcagcaggcgcaaaccgatggcaaacggattagctacgttgatttgcgttatgactcaggtgcggcagttggctgggcgccgctcccccctgaggaatctaatcagcaacagaatcaggcacaggcagaacaacaatgatcaaggcgacggacagaaaactggtagtaggactggagattggcaccgcgaaggttgccgctttagtaggggaagttctgcccgacggtatggtcaatatcattggcgtgggcagttgcccatcgcggggtatggataaaggcggggtgaatgaccttgagtcagtggtgaaatgcgttcagcgcgccattgaccaggcggaattgatggctgattgccagatctcctcggtatatctggcgctttccggcaaacatattagctgtcagaatgaaattggtatggtgcccatttccgaagaggaagtgacgcaggaagatgtggaaaacgtcgtgcatactgcgaagtcagtgcgcgtgcgcgatgaacatcgcgtgctgcatgtgattcctcaggagtacgccattgactaccaggaaggcattaaaaatccggtcggtctttccggcgtgcgtatgcaggcgaaagtacatttgattacctgccacaacgatatggcaaaaaacattgtcaaagctgttgaacgttgtggtctgaaagttgaccaactgatatttgccggactggcggccagttattccgtgttaacggaagatgaacgtgaactgggcgtctgtgtcgtggatatcggcggtggtacaatggatatcgccgtttatactggcggcgcgctgcgtcataccaaagtgatcccttacgcggggaacgtggtgaccagcgatatcgcttatgcctttggtacgccgccgagcgatgctgaagccattaaagttcgccacggttgcgcgctgggttccattgtcggtaaagacgaaagcgttgaagtaccgagcgtaggcgggcgtccgccgcgcagcctgcaacgtcagacgctggcggaagtgattgagccgcgttacaccgagctgctcaatctggtcaacgaagagatattgcaattacaggaacagcttcgccaacaaggggtaaaacatcacctggcggcgggcattgtgttaaccggcggcgcggcgcaaatcgaagggcttgctgcttgcgctcagcgcgtgtttcatacgcaggtgcgtatcggcgcgccgctgaatatcaccggtctgacggattatgcccaggagccgtattactcaacggcggtgggattgcttcactacgggaaagagtcccacttaaacggtgaagcagaagtggaaaaacgtgttacggcatcagttggctcgtggatcaagcgacttaatagctggctgcgaaaagagttttaatttttatgaggccgccagatattacggcctcaggcgacaggcacatgacggagagagattatgtttgaacctatggaactaaccaacgacgcggtgattacagtcatcggcgtcggtggtggcggcggtaacgctgttgaacacatggtgcgcgagcgcatcgaaggtgttgaattcttcgcggtgaataccgacgcgcaggcgttgcgtaagacggcggttggccagaccattcaaattggtagcggcattaccaaaggtctgggcgccggcgctaacccggaagtcggccgtaatgcggcggacgaagaccgtgaagcgctgcgtgcggcgcttgaaggcgcagacatggtatttatcgcggcaggcatgggcggcggtaccggaaccggcgcggcgccagtggttgctgaagtggcaaaagatttaggtattctgaccgttgccgtggtgactaagcctttcaattttgaaggcaaaaagcgcatggcatttgcggagcaaggtatcaccgagctgtccaagcatgtggactcgttgatcaccatcccgaacgacaagctgctgaaagtgctgggccgtggcatctccctgctcgacgcgttcggcgcggctaacgacgtgctgaaaggcgcggttcagggtatcgcagagctgatcacccgcccgggcctgatgaacgtcgactttgctgacgtgcgtaccgtgatgtctgaaatgggctacgcaatgatgggctccggcgtggcgagcggtgaagaccgtgcggaagaagcggctgaaatggctatttcttctccgctgctggaagatatcgacctgtccggcgcgcgcggcgtgttggtcaacattacggcgggcttcgacctgcgtctggatgagttcgaaaccgtcggtaacaccatccgtgcctttgcgtcggataacgccaccgtggttatcggtacctctctggacccggatatgaacgacgaactgcgcgtgaccgttgttgccactggaattggtatggacaagcgtcctgaaatcactctggtcaccaataaacaggtgcagcagccggtgttggatcgttatcagcagcacggtatggcgccgctgacgcaggagcaaaaaacggtcgcgaaagtggttaacgacaatgcgccacaggcggcgaaagagccggattatctggatatccccgcattcctgcgtaagcaagctgattaagaattagctggaatttgggattctgggctctttgtgctaaactggcccgccgaatgtatagtacacttcggttggataggtaatttggcgagattatacgatgatcaaacaaaggacacttaaacgtatcgttcaggcgactggcgtcggtttacacaccggcaaaaaagtcaccctgacattacgccctgcgccggccaataccggggtcatctatcgtcgcaccgacttgaatccaccggtagatttcccggccgatgccaaatctgtgcgtgataccatgctctgtacgtgtctggtgaatgagcatgatgtacggatttcaaccgttgagcacctgaacgctgctctggcgggcttaggtatcgataacatcgttattgaggttaatgccccggaaatcccgatcatggatggcagtgccgctccgtttgtctacctgctgcttgatgccggtattgatgcactgaactgcgccaaaaaattcgtacgcatcaaagagactgttcgggttgaagatggcgataaatgggctgaattcagaccgtacaatggttttacgttggatttcaccatcgactttaaccatccggcgatcgattccagcagccagcgctacgcgatgaacttctctgcggatgcgttcatgcgccagatcagccgtgcgcgtaccttcggttttatgcgtgatatcgaatatctgcagtcccgcggcctgtgcctgggcggcagcttcgattgtgccatcgttgttgacgattatcgcgtattgaacgaagacggcctgcgttttgaagatgaattcgttcgtcacaaaatgctcgacgcgatcggtgacttgttcatgtgtggtcacaatattattggtgcgtttaccgcgtataaatccggtcacgcattgaataacaaattgttacaggcagtcctggcaaaacaggaagcctgggaatttgtgaccttccaggacgacgcagaactgccgttggctttcaaagcgccttcgacggtactggcataacgacatacgctgtcgtataaaattcgactggttaacctggcactctctccggccaggcgagctagtcgttttttttttactatcctttatctgcgctttccttaatacagccattttgacagggttaaatggaaacacggcgcgttcgctgttttcttagccgattttcaccttagcttctcgtcattactgctgtagcgcgtacgctttaatgataagatttgtgcgcaaattgttttgattccgtaagcccatgaggggcatatcaggtggcaatgacgtgagtggaatactgacgcgctggcgacagttaggcagacgatacttctggccgcatctcttattagggatggtcgcggcgagttttggtttgcccgcgctcagtaacgccgctgaaaccaatacgcctgcaaggacgaccgccagcaccgcgtctaaagttaactttagccatcttgcgctgttagaagcctctaaccgtcgtcccaatttcaccgtagattactggcatcagcacgctattcgcacggtgattcgccacctttcttttgcaatggcgccgcaaacgctgcccgttgccgacgcgccgtcgccattacaggcgcatcatatcgccttactgaatacgctcagcgcgatgctcacgcaggagggcacgccgccggcgattgttcgccgcctctccctggcgtattttgcgccacaaaccgcatttagcatcccggcctggataagtcaggcgcagggtatccgcgccggtccgcaacgtctcagctaacgaaaaaagacccttttactttatttgtagctccgcggcgcggggcatttgagactttattatgctaatcaaattattaaccaaagtattcggtagccgtaacgatcgtacgctgcgtcgtatgcgtaaggccgtcagccttattaatgcgatggaaccggagatggaaaaactctccgatgacgaactgaaagcgaaaaccaacgaatttcgcgcccgtattggaaaaggcgaaagcgtagagagcctgattccggaagcgttcgcggtggtgcgtgaagccagtaaacgcgtctttgggatgcgtcacttcgacgttcagctattgggtggcatggtgctcaacgatcgttgtattgccgaaatgcgtactggtgaaggtaagacgctgaccgcaaccctgccagcctacctgaacgcgctgtccggcaaaggcgttcatgtggtgaccgtgaacgactatctggcgcagcgtgacgccgaaaacaaccgtccgctattcgaattcctcggtatgtccgttggtatcaacctgccaggtatgcctgcgccagccaaacgtgaagcttacgctgccgacatcacttacggcactaacaacgaatacggttttgactacctgcgcgacaacatggcgttcagcccggaagagcgcgtgcagcgtaaactgcattatgcgctggtggatgaggttgactccatcctgatcgatgaagcgcgtacgccgctgattatttccggcccggcggaagatagctcggaaatgtacaaaaaagtgaacaaaatcattccgcacctgattcgtcaggagaaagaagattctgacactttccagggcgaaggccacttctccgttgatgagaaagcgcgccaggttaacctgaccgaacgcggtctggtgctgatcgaagagctactggtgcaagaaggcattatggatgaaggcgagtcgctctactcgcctggcaatattatgttgatgcatcacgtcaccgccgcgctgcgcgcgcacgcgctgtttacccgtgacgtggattacattgtgaaagacggcgaagtcatcattgttgatgaacataccggtcgtaccatgcaggggcgtcgctggtctgacggtctgcaccaggcggtagaagcgaaagaaggcgttgaaattcagaatgaaaaccagacgctggcgtctattaccttccagaactacttccgtctgtatgaaaagctggccggtatgaccggtacggcggatactgaagccttcgaatttagttctatctataagctggacaccgtcgttgttccgaccaaccgtccgatgatccgtaaagatttgccggatctggtctacataaccgaagcggaaaaaatccaggccattatcgaagatattaaagaacgtaccgcgaacggtcagccagtgctggtcgggacgatttctatcgagaaatctgaagtggtctccagagagctgaccaaagcgggcatcaaacataacgtactgaacgcaaaattccacgccaacgaagcaggcatcgttgcgcaggctggttatccagcggcggtcactatcgctaccaacatggcgggtcgtggtaccgatattatgctgggcggtagctggcaggcggaagtcgctgcgctggaagcgccgacggaagaacagattgcgcagattaaagcggactggcaggtacgccatgacgcggttctggctgccggcggcctgcatatcattggcaccgagcgccatgaatcccgccgtatcgacaaccagctgcgtggccgttccggtcgccagggcgatccgggttcttcccgtttctacctgtcgatggaagatgcgctgatgcgtattttcgcctccgatcgtgtctccggtatgatgcgtaaactgggaatgaagccgggcgaagcgattgagcacccgtgggtgacgaaagctatcgctaacgcgcagcgtaaagtagaaagccgtaacttcgatattcgtaagcaactgctggaatatgatgatgtggcgaacgatcagcgccgtgcaatttatacccagcgtaacgaactgctggatgtgtctgacgtgagcgacaccattaacagcattcgcgaagatgtctttaaggcgactatcgacgcctacattccgccgcagtcgctggaagagatgtgggatatcccgggtttgcaggaacgcctgaaaaacgacttcgacctggagatgccgattgccgaatggctggataaagagccggagctgcatgaggagacgctgcgtgagcgcatcctggcgcagtccatcgaggtgtatcagcgtaaagaagaggtggttggcgctgaaatgatgcgtcatttcgaaaaaggcgtgatgctgcaaacgctcgattccctgtggaaagagcatttggcggcgatggattacctgcgtcagggtattcatctgcgcggctatgcgcaaaaagatccgaagcaggaatacaagcgcgaatccttcgctatgttcgccgcgatgctggaatcgctgaaatatgaagtgatcagtaccctgagcaaagtccaggtacgtatgccggaagaggtcgaagcgatggaaatgcagcgtcgcgaagaggcggagcgcttggcgcagatgcagcagctaagccatcaggatgacgatgccgccgtggctgccgatctggccgcccaaaccggcgaacgtaagattggacgtaacgatccttgcccttgtggttccggtaagaaatacaaacagtgtcacggtcgcctgagctgatgcgataaacttaccggcctgataagacataatgtgttgccatcaggtcggtcggtgctggcattattgccgaagggcgctacgcttattcggcctagcattgaacacagataaaaaggcgcaggcgactgcgccttttttatggatgcaccaagatgaaaaaactgcaaatcgcggttgggattatccgcaacccgaacgacgaaatttttattacccgacgcgccgctgatgcgcatatggcgaacaagctggaatttcccggcggaaaaattgaagccggcgaaacaccagagcaggcgttgatccgggagctacaggaagaggtggggattacgccaacacaggtgacattattcgacactctggaatatcaattcccggatagacacattacgctgtggttttggctggttgaacgctgggagggcgaaccgtgggggaaagaaggacagccgggacggtggatcgcgcaaaacgcgttgaatacggacgattttccgccggccaatgaaccgattattcgtaaattacgccaatttgcgccttagtgggggatcgcaacacgatccccatcgatcttattagcgatttaatgtcgacataatttccggccagtagcgggggccggctgcggcgtcgtgaggaaaaaccgcctcaattgccgccagctcctgcgggcttagggtcagtgataacgcgccgaggttttcatccaccctggcgcagtggcgggtgccgggaatgggaacgaggtgcctgttgcgggccagcagccaggccagcgctaattgtgcgggggtacactctttttcgcgtgccatttgttttattgcttcagccagacgtaaattgcgcgagaagttctcacccatgaatctgggatttgtgcgacggaagtcattcgcagcaaaatcttctggcgttttaatcgtaccggtcagaaatccgcgtcccagcgggctgtaagcgacgaatcctatacccaaccgttcacaggtggaaagtgctgaaatttccgcttcgcgggaccaaagcgaatactcactttgcagcgcggtaatagggtgaacgttatgggcgcgttccagcgtttgcgttgatgcttcggatagcccgagataacgcacttttccctcgcgcaccaggtccgccattgcaccgacagtctcttctatgggaactgatggatcaacgcgatgttgatagtacagatcgatatgatcgacccccaggcgttgcaggctttgctcacaactacggcgaacgtactccggtctgccattgacgccacgcgccatagggttagcagggtcgagaacgataccaaatttcgtcgctaaaaatacccgatcgcgacgatcggcgatggctcttccgactaacctttcattggtataagggccatacatatctgcggtatcgagcagtgttaccccctgatctaacgcataatgtagcgtcttaattgaggtgctgtcgtcatgagcgccgtaaaatgcgctcatgcccatacatcccagtccgatggctgacactcgcggtccgtttgcgcctaatgtacgatattgcatactgcctccatgaggatattttgtgcatggcaggcagtctatacctggcgtataagatgaaaaatagggggaataagcatggtttatgaaggctggcttaataatgcgtcatgatgtgatgtccgtattgcatgctttttgcatgattgctgaaaaccatagcttcacgcgggcagcggcgcagttacatatttccacgtcggcgttaagtcagaatatgcgtcaactggaggatgaacttggcgtgaaattattgaaccgaaccacccggcgtgtcggtttgacagaagcaggacatgcctttcttgccagtatcagacccgcattgaaccatattgatgaggcgatggaacatgcctgccagagccgcgatatacccggagggacattacgcctgaccgtaccgcgcacggcggccacgcttctgttacaacctaatctcgccggcttcatgcgcgattatcccgatattcggctggatatcgatgtgaatgacggttttgtggatttaattaacgaacgctttgatgccggtattcgctttggcgatgcggtacaacttgatatgaatgtcgttccgctcggtgatgttttacgcccggcgatcgtagcatcccctgcataccttgcgcgttttggcacgccgctgcatcctcaggagctcatcaatcaccgctgcctttgccatcgttttacgcgtgagagcgggctatatcggtgggagtttgttcatggagcgcaacggctggaaattacgccggaagccgcgttaatggtgaatgataaagcgttgcgtctctccgccgcgcgtgatggggcagagctaacctacgtttttgaacaggatgtccacgaagacttacaggatgggcggttgtgttccgtacttgaggagtggctgcctgcggcggaccggttttatttgtattatcccggccgcgcgcatatggcgccaaaactacgcgtatttattgattatttttgtcataaggcgatattgccgtctcaacagagctatcaccgttagcgctcttcgctccagtcgtcgctatcagactggtcgccgctgctggcgattcgtttctcttcggcggcccattcgcccaaatcaattaactgacagcgtttagaacaaaatgggcggaaggggctaatttccccccagacgaccggtttaccgcaggtcggacagtttacgacggtcacgtcagacatttttactccttagcaacaggccagttcaaaatcaagacgctccggcaccagaccattttcactatccagcggcataaagcgaatggcaaaacggctcttatggccggaaatttgcggataaagttgtgaatcgagcgtcagcataagacgcagcaaatcggcgtcgtccccgttatcctgataaaaaccgttcaggctggtttgcttacggaaaggcgctgaattacggatcagatcaagcaccagcgtcagcgcctgggtgaggggattcaggctggcaagccagctttcaatctgggcatcgcgctgcgcctgttgtaggtgcaaccagatatgcagagtgggtaaatcgaaactgcaacagccgccaggaatacttaagcgttgacgcacaagagcaatcaagcgatcttcgcgtagctgctggccaatcctcggggcggagatcagcacgctgcccgccgattttaactgctggcgcagggcttcaatacggtcttgatcgacgccgggaacctcaacccaggcctgtaatttacgctgctggcgctccagttctttcagcagttcggtacggacttcgccccgttcgaacacatccagtagatcgctgatattacggaaaaaatgcagtgcgccagcatggtctgcaattggcaggttgatggagagctgttggatcaaaaactctatgcgcagccacgtacgcatcttctcattgagagggtgttcaaataggacctgggtgtgcattacggtttttcctgtgagacaaactgcgacgcgagcttaagataactggcgtgcaggcgggccacatctgatgcgatagcatccggtgcgccgttattatcaataacatcgtccgccacggcaaggcgcgcttcacgcgtcgcctgcgcagcgagaatgtgttcaacatgctcgcgcgtaacatcatcacgctgcattgtgcgtatgagctgcgtttcgggcgtaacgtcaaccaccagtacgcggttggctttttgatacaacctgttttcaaccagcagaggcacaacccataacacatagggcgacgtagcctgttgaaactgtcgttgggtttcctgctgaattaagggatgaagcagagcgttaagccaggctttttcttccggatgcgaaaaaatacgctcacgcagtgcccggcgacgtaacgtgccgtcggcggcgataagttcagaaccaaaatgttccgctattgcgttcagggcgggctgccctggctcaaccatctggcgcgcgataatatccgcgtcgatgacggttattccgaggtcagcgaaggcatcagcgacggtacttttaccgctgccaataccgccggttaaggctacggtatacctcatatctccagcttccggaattttagtttgataatcaaaaggttaaattttaaacatacaaagacgatatgctctgagcattaacctactattcgccaggtaaatttatgggattgtaacgtaaaaaaagagaatttctgagtcttgtacggccatgattagtgcgtatgatagcgtcactggagttgtgagtttcgatttttcgccattaacctcaggaatccgcacatgcgtattgaagaagatctgaagttaggtttcaaagacgttcttatccgtcctaagcgttctaccctcaaaagccgttccgatgtcgaactggaacgtcaattcacctttaaacactcaggtcagacctggtctggcgtaccgattatcgcggccaatatggataccgtcgggacgtttgaaatggcgcaagcgttggccgggtttgatattctgaccgctgtacataaacattatagcgttgaagagtgggcagcttttatcaacacggcttcggctgatgttctcaagcatgtgatggtttccaccgggacctctgatgctgatttcgaaaaaaccgtgcagattctggcgctgaatcctgcgctgaactttgtctgtattgatgtggccaatggctattcagaacattttgtgcagttcgtcgcaaaagcgcgtgaagcatggccgtcaaaaacaatctgcgcaggcaatgtggtaacgggcgagatgtgcgaagagcttatcctctccggcgccgatatcgtgaaagtgggaattggtcccggctccgtatgcacgacgcgtgtaaaaaccggcgtcggttatccgcaactgtcggcggttatcgaatgtgctgacgcggcgcatggcctgggcggcatgatcgtcagcgatggcggctgcaccatgccaggcgacgtagcaaaagccttcggcggcggcgcggatttcgttatgttgggcggtatgctggcgggtcacgaagagagcggcggcagcgtggtagaagagaatggcgagaaattcatgctgttctacggcatgagttcggaatctgcgatgaaccgtcatgtcggcggcgttgcgaaataccgcgcggcagaaggtaaaacggttaaattgccactgcgtgggccggtgggcaataccgcccgcgatatcctgggcggtctacgctcagcctgcacttatgtcggcgcgtctcgcctgaaagagttgaccaaacgcaccacctttattcgggtgcaggaacaagaaaaccgcattttcaatagcctctaatattctggctggcgtaaatgtgcgccagccttatcccatcccgctcatcgcgtctcccaaatgaaaaatcggcaaatacatcgccaccaccagcgtaccgataattaagccggtgatgatcaataacgccggttccaacagcgacgccagattatcggccagcgccagcgtagattcactgtggtgacgggcaaggttatgcagcatgatatcgagtgaaccggacgcttcgcccgttctgaccagttgcaggcatagcggactaaattcctgggtattttttagcgccaaccagaccggattgcccgcggcgatctcctgatgtacctgcgttaaacgctgtgaccagtaagggcagccgagactatcgatagcgctttccagtccctgaagaaaaggaatgcctgcgctttgggttaatgccagtacggtgaatatttgcgctagtttctggcctcttatcaggcgacccataacgggaagccgtagcagaagacgctgccgctgcgcttgccaggacggtttttgttttaacctgcggtgagcgatagcaacgagcatcgtcaggaacaagatgagccaaccccatgccggcccccattgcgctatcgcgataataccgcgtgtcagaagaggaagcggggtattgaagctacggtaaatggcggcaaattccggcaggacaaagtgcagcatggcgaaaacgaccagggcggccattgttagaataatggcgggatagcgcagcgcctttttcacgctaaccgtaatctgccgttgcgctttttgctgacgggccagttcaaagcagcattcggccagtttgccggtcagttctccggtgcggatcatcgtctggtagagcggcggaaatacctgcggccaggagactaatgcgctggaaaaagggacgccctgttcaagctcgtgagccagcgtgcgcaacagcgcttgccattgtcggtggggatgctgtttcgcaaggagttccagcccttcagaaagcgtcagtccggcatgaatgagcgtggccaactgatgaataatttcagcgctttgctcttctttccacagtgcggcgttaacgcttatgcgcttgatgcgaagcggcataatgcgctgatgttgcagggtgatgatcagcgccagacgattgtccacccatacaacgtcttgttccagttgacctttatcgttaacgccttgccagcgccagagctgtttaacgctcatggggcattcccagaacgcgcagtatctcttcaaaggacgtcatgccttgctcaacggcgcgacagccattttcaaaaagcgtccctgtaccggtctgctggaggtgggcttccagtgcttgcgccgatgcgccgctcgcaattaactgacgtaatgccggggtaacggttaacacttcgaataacgcggttcggccataaaagccgtggtagcaatgctgacagccgtttgcctgccagcgcggtagcgcgctgggccaaagattgggcgatagcaccacgggatcgctcagacgctgtttgcagtgcgggcaaagcttccttaccaggcgttgcgctaccaccagcgtaagcgccgatgagatcatccagcgtgttacgcctatttgctgcaaacgtatcagggtttcgctggtggagttcgtatggagtgttgaaagtaccagatggcccgtttgtgccgccttaatggcgatttctgcggtgtcgccgtcacgaatttcacctaccatgatgatgtcagggtcctggcgtaaaagcgcgcgcagcacattttgaaaggtgagcccggcgcggggatggatctgcgtctggttaatcccatccagtggaatttctatcggatcctcaacgctacagaggttgatacccggcgtattccgggtttgtagcgcgctgtatagcgtgaccgtttttccgctaccggtggggccagtcaccagtaccagcccctgaggttgctgtagggcttgtctaaaagcggtaagttgtgccccgtacatgcccagcgtgtccagatccagcgtttgttcaacctgatgcaacaaccgtaagacgactttttcgccttctttacagggaagcgtggcgatacgaaaagagatgctgtcgcccgtcaggtcaacggtaaattgcccgtcctgcggcagccgatgttcagcgatgtccaaatttcctaggactttcaatctggccgtcagcgcaagccccgtctctttggcgatgtcctgcagaatatgaagaacgccatcgatgcggagccttatccggtagcggctggcgccgggttcgagatggatatcagaggcgcgtttcgccatcgccgagcgtaatgtctgattgagaagctgggccgcggtttctccgcctttcgcggcgtttgtcgagggtgcctgatccggcttatgccgatgattttccatttgctggcgagtccagcacacaatatcaatctgtttttgcgtggcgaaatgcagagcgtccaataacgcatgagagggcgcgtcgaccaccgcaacagtgatactgttgctggcgctattgatcagtacagcctgatgacgttgacacaaggtgttgagctgagcgtctttcatcttgtctccttagttggcgtcaaaacggaagacatcttcacaagcctgttgtaacgcgctgtcgctttgaatattgcagttacgcgtccagccggtaatgccgttagcattgtcccaggcgggcgtcatgatgacgctaagcccgctcagactctcctgaccggtaagcgtgatgacgcctttttccacgctcatgcccgaaacataacgggtgatgacgggcgaggggataccgttgacgcccgcatcgcatgtgctcgtcccaccatgttccagagcgcagagttcgacggcagtacggtaggggacaaatgtttgcaacatatccgtcagcgccgctttacgcagatagttctggtaagccggaatgccaatggcgcttaaaatggcgatgatgccaataacgaccatcagttcgataagcgtgaaaccgcgttgtttttccattgttcgctccttgagttagccggcgctactgtggcaaacaagggaagagcgggcgagcggcaaaaggtaaaacgggaaggcggattctgaagattttcgctgcgttacatgacacggcaacgttattgcgaggcgctacgaatattttaccgaatcacgacgcggatctacggacaggtgatttatagacccgacggcgcagcgccatcgggcggagaggatcagcaaaaacgcatggagagatcgagcgcgcgcacgtgcttggtcagcgcgccaacggagatgaaatccaccccggtttcagcaaattcgcgtaaggtttccgcggtgacgttgccggatacttccagccgcgcctggccgttgacgtgtttcaccgcctcgcgcatctggtcggtgttgaaattatccagcatgatgatatccgcgcctgctttcagcgcatcgtccagttcatccagattttcgacctcgacttctaccggcacgtccggatgtagccagaacgctttttccaccgcctgacgaaccgaaccggaggcgatgatatggttttctttaatcaggaacgcgtcagtgagacccagacgatgattggcgccgccgccgcataaaaccgcatatttgagcgcggtgcgcagacccggcagcgttttacgcgtgtcgagcaactgggtttgggtgccagccaatagtccaacgtagcggcgtacttcactggcgacgccggaaagggtctggacaaagtttagcgccgtgcgctcgccggtcagcaatacgcgagcggggccgttcagttcaaacactgtttggttggcgtgaatggcgtcgccgtcatcgacatgccaggtgaggcgcacatcatcgcccgccagttggatgaagacctcttcaacccagcgcttgccgcagaaaacgccgtcttcacgagtgatcactgtggcatgggcttgcgtatctgccggcaaaagttgcgcggtgatatcgttgccagcatcgacttctccacctaaatcttcacgcagcgcctgagcaacggcggcagggatatcgagattaatgcgttccagtagcgcgtcacgtcggtcgtctgggttataacggcgaggcggcatgataaaactccaaattgctaacgaatcataaggtagaaacatgctactctgaagcagctataagcaccactcaaaaggagactccgcatgttgccagataagggttggttggtagaggcgcgacgcgtcccttctccgcattatgattgccgtccggatgacgaaaaaccgtccttgctggtggtgcataatattagcctgccccccggcgagtttggcggtccgtggatcgatgcattattcaccggaacgatagatccagacgcccatcctttttttgcagaaatcgctcatcttcgtgtttcggcccattgtctgattcgtcgcgacggtgaaatcgtccagtatgtgccttttgataagcgtgcgtggcatgcgggcgtatcaaactatcaggggcgggaacgttgtaatgatttctccattggtattgagctggaggggacggatacgctggcttataccgatgcgcagtatcagcagctagccgccgtgacgcgcacgcttatcgcttgctatccggcgatcgccgacaatatgaccggacactgcaacattgcgcctgaccgcaaaacggaccctggccctgcctttgactggccgcgctttcgcgctttggtagccctctcgtcgcacaaggagatgacatgacgctgtttacgacattactggtgctgattgtcgagcgcctgtttaagctgggcgagcactggcagctcgatcatcggctggaggcgctattccgtcggattacgcatttttcgatgttgcgcacgatgggaatgacggcgatcgcgatggtggtgacttttctactgctccaggcgttaaaagggctgctatttaacgtgccgacgctggtggtgtggattctcctgggcgtgctgtgtatcggcgcgggcaaagtgcgagtacattatcacgcctggctgaaagcggcgtcccgtaacgatccgcatccttgcgaggcgatggccagcgagcttacgctgattcacggcgtgccgccggattgtaatgagcgtgagtttttgcgtgagctgcaaaacgcgttgttatggataaatttccgtttttacctcgcaccgctattttggtttatcgttggcggtccgtgggggccggtaacgctggtgggctatgcgtttttacgggcctggcagacctggctggcgcgctatcagacgccgcaccaacgtttgcaatccggcattgacgctattcttcatgtactggactggattccggtacgtctggcgggcgtagtgtatgcattactggggcatggcgagaaagcgttgccggcctggtttgcctcgctggcggatctgcatacttcgcaatatcaggtgctcacacgtctggcgcagttctcactggtgcgcgaaccgcatactgacaaagtagaaacccccaaagcggcggtatcgatggcgaagaaggcctcgtttgtggtggtggtgattattgcgttgctcaccatttatggggcattagtgtaatgttgtgccgatagcgctaacgcttatgctgcctacaatggaaaaatctgtaggcccggtaagcgctagcgccaccgggcagtgcaacggcttagatcgtatcggctggcggcacgccaaaatcaggcatcccgttttcgtcccagcgcacccgtttcagacgcgtatggcggttgggatcgtacaacggatcgccttcaatttcggtgtaatttctcgcgtggtacaccagtacatcttcaccttccgacgtttgcgtaaagctgttgtgtcccggcccatactggcgattttcatagctggtggtaaagaccgggcgcggtgatttatgccagttggccggatcgcgcggatcgtcgtttacgttaatccacagtaaccccatacagtagttttcatcggtggcgctggccgaatagctgataaacagcttgtcgccatgcaccacgacggccggaccttcgttaacccaaaaaccccgacattcccagtcgtactctggcttactgagtcttaccggctcgcctttaagggtccacggattttccagttcagccagataaatatttgagttaccggcaatatccggcgctttttgcgcccacagataccactgttttccctgatgataaaaagtggtggcatcgagggagaaggtatcaaacggcgttttaatttgacccttctccgtccacttgccggtgagtgggtcggcatcggcgcactccagggcaaacatgcggtgctggaacattcccagtttatcaagcgcttgagtatgggtagcggcaaaatagatgtaccacttaccgttgatgcggtgcatttccggtgcccagatgagctggctcatcgggccgctttccggtttgcgccagacgacaacggggtcggcggcgcgcaacccttccagcgaatcagcccggcggatttccagcctgtcatattccggtacggaggcaataaagtagtaatcgctgccgtcgcgtaaaataaacggatcggcacgttgttcaataaacgggtttggccagtttgccatcaggctttccttacgctttcagcggctttgagctcctgcaactcactcaattcgcggtaattagtgcgacgtttttccaaatcgtcctggatttttttcatcagttcacggtcaactttcagcagacgtaccacgcctgcggtaatcagatagccaacgccaaggataacggtaaacaacagcataataccgttcatcgccgaggcgctttgcgctttggcgctggcgtcataaccgtaccaggagagcaaaaagccgaccatcgccccggcaatcgccaggcccagtttcaggaagaacagattaccggagaagctaataccggtaatgcgtttgccggttttccattcgccgtaatcatcgacgtccgccatcagcgaccagtgtaacggggaagggatctgatgcagaatattgagcaagaagtagagcgccactatcatcacggtggctttcgggtcaaagaaatagaacgcgcaggagaaaatcgccagcgcgatattggtccagaaaaataccttcaatttacaccagcgatcggttaagacttttgccagcatactgccgatcatcataccgaccacgccaagactaataaaaagcgtagcgaaatgggtgctttgtcccatcacccaggtgacgtaatacatggtcgccgccatacggataaaccccgggcagacgttacataaggtcaatagcagaatgcgtacccattgatcgtttttccacacatctttgaaatcattcttcatatcatcgtgcgtcggaacggcagggcgaacgcgttcgcggacgctggcaaagcagaacagaaacatacccatgccgataatcgccagcacggtcatcgccaactgatagcctttggctttgtcgccgtcgccaaaccagtccaccatcggcaatagcgttaacgatagcaacagcgtcgcgatgccgactaacacgaagcgataagcctgacaggctacgcgctcttttggatcgttagtgatcacgccgcccagtgagcaatagggaatattgatggcggtataggtcacggaaagcagaaaataggtgacgaaggcatagataactttgctgttatagccccagtccggcgtcgtgaacatcagaacgctgaacagcgcgtagggaaatgcaatccacagtagccaggggcggaaacgaccatatttactttgggtacgatcggcaagcgcgcccatcaccggatcggtaacggcatcgataacgcgtactgaaaggagtaaaacaccgactaacgctggggcaagaccaaaaatatccgtataaaagtaattaacaaacagcatgatagcgccaaaaataatgttatatccggcgtcacccatgccatacccgattttctctcttaccgaaagtctgcccttatccattgagacttctccccatcagatgatggcggtaattattcgcctgcgagcttttttttgcgtagcaggatcacgccgctgatatggataaaatggttatacgtgggaaactgtgaggcagataacaccctccccggacggggagggcggaaaagtaacgccacgatcagtgggctttcaccgtttttgccgttttttctttacacaggtagccgacgcccaggatgagcagccataccggaatcagccacacggagatcgccatacctggcgtcatcagcataatgatcaataccgccgccataaacagcaggcagagaacgttgccgaacggataaaacagggccgggaagcgggttttcacgccctgctgctgtttcgcgcgacggaacatcatatgggcaaggctaatcatcgcccagttaatgaccagcgcggagaccaccagcgccatcagcagtccgaatgcggactctggggccaggtagttgagcagcacgcacaacgccgtcacgacggcggaaaccaaaatggagctcaccggcacgccgcgtttgtcgacgttcagcagcgctttcggcgcatttccctgctgggccagaccgaacagcatacggctgttgcagtaaacgcagctgttataaaccgatagcgcggcggtgagaaccacgatattcagcgcattggcgacaaacgtatcgcccagctcatggaagataaggacaaacgggctggtatcggcggtgacgcgagtccatggcagcagcgaaagcagaaccgccagcgagccgatataaaaaatcaggatgcgatagataacctgattggtagctttggggatgctctgttccgggttatcggcttcagcggcggtgatccctaccagctccagtccgccgaacgaaaacataataatggccatcatcatcaccagcccggtccagccatgcggcagaaagccgccctgttcccacaggttgcgcacggtggcctgcggaccagcggtatcgctgaagagtaaccacgcgccgaacagaatcatagcgatgacggcgatcactttaataatggcgaaccaaaactccatctcaccgaacactttaacgttggtcaggttgatggcgttgataatcacaaagaaggctgccgcagaagcccaggtggggatctccggataccagaactggatatatttacccactgcggtcagttccgccatggcaactaatacgtacagcacccagtagttccagccggaagcgaatccggcaaagccgccccagtatttataggcgaagtggctaaaagagccggcgaccggttcttcaaccaccatctctcccagctggcgcataatcagaaaggcaataaagcctgcaatcgcatagcccaggataattcctggccccgccgactgaataacggaggcgcttcccaggaacaagcctgtccctatcgcgccgcccaatgcgataagctgaatatggcggtttttcaggccgcgcttgagctgctcgccgtgctgctgactgtccatcataaaacctcgtgtatcgggcgcggtttattcataacgcgcttattttgaacgatgcagtagtgcgtgtgtaagtttgcaattccgctttttgtattgatttatttacaagctcgttttttaaaatgtcacttcaactctttcgtcttgatcagaataatggtatgtggccgcgaatgcacctgctttgtgcaggggtgatgacgagttgcgtaaaaagaaagcacttgtaaatacctccttttattttcccttctaaaggttaatttgtttttattcattatttatgcataaaaatgcatttgatctgctgttgaatcggttcagatgagattttttatcgtttcaaatacgttaaatctacctcctggtgggtaaatttaacatttgtgcacagttacagttttgaaacgtgatttctgtaaaattgttaaaatgtgcctcctttactgatttcaatcaaaacctgtatggacagaaggtgaatactttgttactttagcgtcacagacatgaaattggtaagaccaattgactccgggcaaatggcttaagacaggaaatcatggcctacagcaaaatccgccaaccaaaactctccgatgtgatcgagcagcagctggagtttttaatccttgagggaacattgcgtcccggagaaaaactcccaccggaacgtgaactggcaaaacagttcgacgtctcccgtccctccttgcgcgaggcgattcaacgtctcgaagcgaagggattgttgcttcgtcgccagggcggcggaaccttcgtgcagagcagcctgtggcagagctttagcgacccgctggtggaactgctctccgatcaccctgaatcccagtttgacctgctcgaaacgcgccatgcgctggaaggcattgcggcttattacgcggcgctgcgcagcaccgacgaagataaagaccgtattcgcgagctgcaccacgctattgagctggcgcaagagtccggcgatctggatgccgagtccgaagccgtgctccagtatcaaatcgccgtcaccgaagcggcgcacaacgtggtattgcttcatctgctaaggtgtatggagccgatgctggcgcaaaacgtgcggcagaacttcgaattgctgtatgcgcgtcgggagatgctgccgctggtgagcacgcatcgcacccgtatatttgaagccattatggccggaaaaccagaagaagcgcgtgaagcgtcacaccgacatctggcgtttatcgaagagattatgctggacagaagccgtgaggagagccgtcgtgaacgcgctttacgccgcctggaacagcgcaagaattagttttttctggcagaacgttaaccagaagatgttgtgaataacgcgcaaaaatgtgcgcggcaactaaacgcagaacctgtcttattaagctttctgacgaaagtttaatgggacaggttccagataactcaacgtattagatagataaggaatacccccatgtcagaacgtttccaaaatgacgtggatccgatcgaaactcgcgactggctacaggcgatcgaatcggttatccgtgaagaaggtgttgagcgcgctcagtatctgattgaccaactgctttctgaagctcgtaaaggcggcgtgaaagtcgcggcaggcgcaggggccagtaattacatcaacactattgccgttgaagacgaaccggaatacccgggtaatctggagctggaacgtcgcattcgttctgcgatccgctggaacgccatcatgaccgtgctgcgcgcgtctaaaaaagaccttgagttgggcggccacatggcgtccttccagtcttccgccacgatctatgatgtctgttttaaccatttcttccgtgcgcgcaacgaacaggatggcggcgacctggtgtacttccagggccacatctctccgggcatctacgctcgcgcgttcttggaaggtcgtctgacccaggaacagatggataacttccgtcaggaagttcacggcaatggcctctcttcctatccgcacccgaaactgatgccggaattctggcagttcccgaccgtctctatggggctgggcccaatcggtgctatctaccaggcgaaattcctgaaatatctggaacaccgtggcctgaaagatacctctaaacagaccgtttacgccttcctcggcgacggcgagatggatgagccggaatccaaaggcgcgatcaccatcgccacccgtgaaaaactggacaacctggtttttgttatcaactgtaacctgcagcgtcttgacggcccggtcaccggtaacggcaagattgttaacgaactggaaggcatctttgcaggtgctggctggaacgttatcaaagtcatgtggggcggtcgttgggatgaactgctgcgtaaagacaccagcggtaaactgatccagctgatgaacgaaaccgttgacggcgactaccagaccttcaaatccaaagacggcgcttacgtgcgtgagcacttcttcggtaaatatccggaaaccgccgcgctggtggccgactggactgacgagcagatttgggcgctgaaccgtggtggtcacgatccgaagaaagtctacgcggcactgaaaaaagcgcaggaaaccaaaggcaaagcgaccgtaatcctggcccataccattaaaggttacggcatgggtgacaccgcggaaggtaaaaacatcgctcaccaggttaagaaaatgaacatggacggcgtgcgttacgtccgcgatcgtttcaacgtgccggttgccgatgctgatctcgaaaaactgccgtacattaccttcccggaaggttctgaagaacacaaatacctgcatgaacgccgtcaggcgctgcacggctacctgccaagccgtcagccgaacttcaccgagaagttagagctgcctcaactttcagatttcggcgcgctgctggaagagcaaagtaaagagatttccactacgatcgctttcgtgcgtgccctgaacgtgatgctgaagaacaagtcgatcaaagatcgtctggttccgatcatcgccgacgaagcgcgtactttcggtatggaaggtctgttccgtcagattggtatctacagcccgaacggccagcagtacaccccgcaggaccgtgagcaggttgcttactacaaagaagacgagaaaggccagattctgcaggaaggtatcaacgagctgggcgcaggcgcatcctggctggctgcggcgacctcttacagcaccaacgatctgccgatgatcccgttctacatctactactctatgttcgggttccagcgtatcggcgacctgtgctggcaggctggcgaccagcaggctcgcggcttcctgattggcgggacttccggtcgtactacgctgaacggcgaaggtctgcagcacgaagatggtcacagccacattcagtcgctgactatcccgaactgtatctcttacgacccggcttacgcttatgaagtggctgtcatcatgcatgatggtctggagcgtatgtacggtgaaaaacaagagaacgtttactactacatcaccaccctgaacgaaaactaccacatgccggcaatgccagcaggtgccgaggaaggtatccgtaaaggtatctacaaactcgaaaccctcgaaggtagcaaaggtaaagttcagctgctgggctccggttctatcctgcgtcacgtccgtgaagcggcagagatcctggcgaaagattacggcgtaggttctgacgtatatagcgtgacctccttcaccgaactggcgcgtgatggtcaggattgtgagcgctggaacatgctgcacccgctggaaaccccgcgcgtaccgtacatcgctcaggtgatgaacgacgctccggctgtggcatctactgactatatgaaactgttcgccgagcaggttcgtacttacgtaccggctgacgactatcgcgtactgggtacggatggcttcggtcgttccgacagccgtgagaacctgcgtcaccatttcgaagttgatgcttcttatgtggttgtcgcagcgctgggcgaactggctaaacgtggcgaaatcgacaagaaagtggtagcggatgcgattaccaaattcaacatcgatgcagataaagttaacccgcgtctggcgtaagaggtaaaagaataatggctatcgaaatcaaagtaccggacatcgggacagatgaagttgaaatcaccgagattctggtcaaagtgggcgacaaagttgaagctgaacagtcgctgatcaccgtagaaggcgacaaagcctctatggaagtcccgtctccgcaggctggcgtcgtgaaagagatcaaagtctctgtcggcgacaaaactgagaccggtgcacttatcatgattttcgattccgccgacggtgcagctgacgctgcgcctgctcaggcagaagagaagaaagaagcggcgccggcagcagcacctgctgcggcagcggcgaaagacgttcacgttccggatatcggcagtgacgaagttgaagtgactgaagtgatggtgaaagtgggcgacaccgtagaagctgaacagtcgctgatcaccgtcgaaggcgacaaggcctctatggaagttcctgctccgtttgcaggcaccgtgaaagagatcaaagtgaacaccggtgataaagtgtctaccggctctctgattatggtcttcgaagtggcgggtgaagcgggcgcagcagcaccagcgaaagcggaagccgctccggctgcggctgctccagcagcagcgacgggcgtgaaagacgttaacgtaccggacatcggcggcgacgaagttgaagtcaccgaagtgatggtcaaagtcggcgataaagttaccgctgaacagtcgctgatcaccgtggaaggcgacaaagcctctatggaagtgcctgcgccgttcgcgggcaccgtgaaagaaatcaaaatcagcaccggcgataaagtgaaaaccggctcgctgattatggtcttcgaagtggaaggcgcagcgcctgcggccgctccggctaaacaggaagcagcggcgccggctccggcggcgaaagctgagaagcctgctgccccggctgccaaagccgaaggcaaatctgagttcgctgaaaacgacgcttacgttcacgctaccccactgattcgccgtctggcgcgcgagtttggcgtcaacctggcgaaagtgaaaggcactggtcgtaaaggccgtattctgcgcgaagacgttcaggcttacgtgaaagacgctatcaaacgcgcggaagctgcgccggctgctgcgggcggcggtatcccgggtatgctgccgtggccgaaagtggacttcagcaagtttggtgaagttgaagaagtggaactgggccgtatccagaaaatctctggcgcgaacctgagccgtaactgggtgatgatcccgcacgttacgcacttcgacaaaaccgatatcaccgatctggaagcgttccgtaaacagcagaacgccgaagctgagaagcgcaaactggatgtgaaatacacgccagtggtcttcatcatgaaagcggttgccgctgctctggaacagatgccgcgcttcaacagctctctatccgaagacggtcagcgtctgaccctgaaaaaatacatcaacatcggcgtggcggttgataccccgaatggcctggtggttccggtctttaaagacgtgaataagaagagcgtgaccgagctgtctcgtgaactgaccaccatctccaaaaaagcgcgtgatggtaagctgaccgctggcgaaatgcagggtggttgcttcactatctccagcatcggcggcctgggaactacccactttgcgccgattgtcaacgcgccggaagtggctatcctcggcgtttctaagtcggcgatggaaccggtgtggaatgggaaagagtttgtgccgcgtctgatgatgcctatctctctttctttcgaccaccgtgtgatcgatggtgctgatggtgcgcgtttcattaccattatcaacaatatgttgtctgacattcgccgtctggtgatgtaagcgaaaaagccggcccgacggccggcttttttttgataatctcatggagtttgtgaggttattagcgaaagcgataattcgtgatccgtttgttgtttcaaaattgttaacaattttgtaagatacgggcggatagaacgacccggtggatgatgggcgatcaagtaccccggaccgccggatacaaataaagaggtcatgatgagtactgaaatcaaaactcaggtcgtggtacttggggcgggcccggcaggctattctgccgctttccgttgcgctgatttaggtctggaaaccgtaattgtagaacgctacaacacccttggcggtgtttgtctgaacgtcggctgtatcccttctaaagcgctgctgcacgtagcaaaagttatcgaagaagccaaagcgctggctgaacacggtatcgtcttcggcgagccgaaaaccgatatcgacaagattcgtacctggaaagagaaagtgatcacgcagctgaccggcggtctggctggtatggccaaaggccgtaaagtgaaagtggtcaatggtctgggtaaattcaccggggctaataccctggaagtggaaggcgaaaatggcaaaaccgtgatcaacttcgataacgcgatcatcgcggcgggttctcgtccgatccaattaccgtttattccgcatgaagacccgcgcgtatgggattctaccgacgctctggaactgaaagaagtgccgaagcgtatgctggtcatgggcggcggtatcatcggtctggaaatgggtaccgtataccacgcgctgggttcagagattgacgtggttgaaatgttcgaccaggttatcccggcggctgataaagacatcgttaaagtcttcaccaaacgcatcagcaagaaattcaacctgatgctggaaaccaaagtgactgccgttgaagcgaaagaagacggtatctacgtttcgatggaaggcaaaaaagccccggctgaagcgcagcgttatgatgcggttctggtggcgattggtcgtgtgccgaacggtaaaaacctcgacgcgggcaaagctggcgtggaagttgacgaccgtggctttatccgcgtcgacaaacagctgcgcaccaacgtgccgcacatcttcgctatcggcgatatcgtcggtcagccgatgctggcgcacaaaggcgttcacgaaggccacgttgccgctgaagttatcgccgggaagaaacactacttcgatccgaaagttatcccgtctatcgcgtacaccgagccagaagtggcatgggttggcctgaccgagaaagaagcgaaagaaaaaggcatcagctatgaaaccgccaccttcccgtgggcagcttctggccgtgctatcgcttctgactgcgcagacggtatgaccaaactgattttcgacaaagaatctcaccgcgtgatcggcggggcgattgtcggtaccaacggcggcgagctgctgggtgaaatcggtctggcgatcgaaatgggctgtgacgcggaagatatcgcgctgaccatccatgctcacccgactctgcatgagtccgtgggcctggcggcggaaatcttcgaaggtagcattaccgacctgccaaacccgaaagcgaagaagaaataatcttctgcgggtggcaatgcgccacccgatacagaaaagcggctttacagccgctttttttatgcatggcaaatcagatgtgtcaaatgatggcgaaggataacgaaaccgcaaaatttatcctttccgcagcagtacgtttttcaaagcttatgccgtcggtagtgcctttgtctgtcattttcgaccaactaattgtttcataagaaatacctctccttaatttgtcatcatcctgaaattggtaacgctataaaataatagcgagctaattatgaggtttgatatatgaaactttttctgacaacggcagcgctaactgcgaccttgatttccggcatggcatttgccagcgatcccgtcatcccctgggcgactaacagcggcggtacggaaagcacgcatattgcggcaatgggcgaggatttgaatgcgcagcatcagcagatcacccacacgcatgaaggcgtatgggcggccaattccggcagcattcaggctgatgaagccgcgctgaccagcaacaagccgccggtacaaggccacccggaattgatgccgcatcagggctaatgatcacggcctggcgataacgccaggcgcttacgggttattcggcgacctgccactgcgcgtctggcgcaaaacgcgtgatagcctgaactttactctccgtctccttgcctaaatccgcctgataaatacgatcgtcctggttgaccataaaactcatcaccccggtttcgccgtaatgcatcggccaggccagaagcgccgcaccgtgaccgtcgttatcgctgataatacggaaatggtagccgtggtaaccctcgtctggcgctgcgggactaaagtttgggcctaacggactggggacgtcgcctgctttggttggccagtacaggccatctttttggccttcgctactgattatcctgtgcgcccagcgatggttttgtaagtaatagtcctgctgcgcatcaacgtaagcatgcatggcctgtaaggtagaaagttcatttcgcccaatagtacgggtgaggatctcattcccggctgccgccatatcaaagcgccagccgccagtctctttcaccatgggcaccgggagctgccagtcttctcgtccgacattcaggtgcgccgtattgtctttttgtacaatgcgatggccttcgcgccagtcacgattgaagcgggccacggcctcgggatcggcaccttccggcggcagaaattgccgccagtcatcgcccagtagcgcggtaagctgcgtttcgttttttccggctaccgccgcggcgaaggcgctggcggccgcttccggggaggggaaccgttcctgcgcgtagcccagcaagggtaacgacagtaacagagcgcttaacataacctttttcattatctgctccggttaacggcgatgaaattcatgatgttcagaaaaatgttcccgcgcggcggcgcgttgctcggtgttcaagtgactgccgcgacggctttctaggccgcgtagctgttgcgattgccatgacggcgatcgactgtcgttcccgctaaacacattggcgtgcatattctggcgaaatgcctgacgctgctgtggcgtagaggattcaatacgctggcgggcggtgtctctctgctgttgtgaaacagggtgctgctgggctttagccttcagctcggaacgatgctgctgcgtggtggatttattcagtgtctgctgcgccgcctcgcgacgactgctgttttgtgttccgtcatagccacggtaattattacgctgggcaatttgatttaactgctgcgatgccgctttgcgctgtctgtcgcgggatgtctcgcctgacacgttagcgggtgatgtatggctgcgctgttggaattgcgccatggctgcctggcgctgactgtcgcgagacactggcgcttgctgcgttgcgcttaacccgccgctaacattggtgggatggaaccgttgcgcaacggtattattcggataggggacgccattgcgccaggcgggattatgctgccagcccatcgtttggcccggcaggttttgcccggatatccggttgaaattattgacattgatgttgatattatcgccattatgttgataaccgttaccaccatgatggtaatcatcatcatgatggtcgtcgtcatggtggtgatgatcgtcgtcatcccagtctatgctgctgaacaacgcataggtggtggcgacgcccagactataaccaaaacctttaacaaaactgtcggcaaactgctgccccggagggggcggtaaatacaccggcggataagcggtattgggccaggcgccatacaccgtcgtggggttatagtttggcacgtacaccacctgcggattcgcaggttcaattttgatgacggtcgacggtgttgctggcgtactggcggatgtggtggttgtcgtcgtgacggcggtagaagcgctggacttcggcacgctggtgacggtttgctgtggcgtggattttagcgaaccggtttgttgagcgagcagacgcagcctttgcaccgcatccatcacatcctgtggctgggctaagaacgcatcgcccaggttttgcacccattgcggattctcgcccataagcgccatcaactgaggaaaggcgaccagcgatttgacgctggggtcccacggttggctggccaccgcttgaatagcggcatcgccctgcagcgtggggttatcccgcgaccactggacggcctgaaccacgttcgccgggtaggtggaggccatgagcacctgcgaaagcagggcatcgggataaagcgcgacaggcgcgacccattgatcgatttgcgcagtggtaaaggtcgttttcgcgacaggcgcgggcacagcggtctgcgttggctcagaggtgggagctgccgcctgcgcgggcgcttcgggagcgcggcttttaacatacagtacgcccgaagcggcaaataacccggcactgcacacaagggcaatgagatggggtttaaagggcaacgtcattttatctctcccgattcccgagaatcgctatggtcattatgcctgccgccgacggggtgcagtttggcgtgagtataaagggacgatagtttaatttttagctaatgttgggatcggtaacgttacgtgacgatcaaagcacgaaatgaggtaagcatttatggctgcagctcccgtctcagtagagcattagaccatccttaacgattcagccacttttttatgttgcttttttgtaaacagattaacacttaaagaaaatcctgttattgtgccttatgcggtaccgggcatttaccctactaactactgtctcacaggagcgtgaagagaatcgcccatcaacaaaagcgccgcattatgacaatgagagcgaggagatatcgtcgtgctagaagaataccgtaagcacgtagctgagcgtgctgcccaggggattgtgccgaaacctttagacgcaacccaaatggctgcgcttgtcgagctgctgaagaccccgcctgtgggcgaagaagaattcctgttagacctgttgatcaaccgcgttcctcctggcgtcgatgaagccgcttatgttaaagccggttttctcgctgctgtcgcgaaaggcgacaccacctccccgctggtctccccagaaaaagccattgaactgctgggcaccatgcagggtggttacaacattcatccgctgattgacgcgctggacgatgcgaaactggcgccgattgcggccaaagcgctgtctcacaccctgctgatgttcgataacttctacgacgtagaagagaaagccaaagcgggcaatgaatatgccaaacaggtgatgcaatcttgggccgacgccgaatggttcctgagccgtccgccgctggcggaaaaaatcaccgtcaccgttttcaaagtgaccggcgaaacgaataccgacgatctctctccggcgccggatgcgtggtcgagaccggatatcccgttacatgcgcaggcgatgctgaaaaacgcccgtgaaggcattgagccggatcagccaggcgttgtcggcccgatcaaacaaatcgaagcattgcagaaaaaaggctacccgctggcctacgtgggtgacgtggtgggcaccggttcttcccgtaaatccgcgaccaactccgtgctgtggttcatgggcgatgacatcccgaacgtgccgaacaagcgcggcggcggtctgtgcctcggcggcaaaattgcgcctatcttctttaacaccatggaagatgcgggcgcgctgccgattgaagttgacgtttctaacctgaacatgggcgatgtaattgacgtctacccgtacaaaggcgaagtgcgcaatcatgaaaccgatgaactgctggcaaccttcgaactgaaaaccgacgtgctgatcgacgaagtacgcgccggtggccgtattccgctgattatcggacgtggcctgaccaccaaagcgcgtgaagcgctgggtctgccgcactctgacgttttccgtcaggcaaaagacgtggcagaaagcagccgtggcttctctctggcgcagaaaatggtcggtcgcgcctgcggcgtgaaaggcattcgtccgggcgcgtactgcgaaccgaaaatgacctccgtcggttctcaggatactactggcccgatgacccgtgatgagctgaaagacctggcctgtctgggattctccgccgatctggtcatgcagtcgttctgtcacaccgcagcctatccgaagcccgttgacgtcaccacgcaccacacgctgccggacttcattatgaaccgcggcggtgtctccctgcgtccgggcgacggcgtgatccactcctggctgaaccgtatgctgctgccggacaccgtcggtaccggcggtgactcccatacccgtttcccgattggtatctctttcccggcgggttctggtctggtggcgtttgccgccgcgaccggcgtgatgccgctggatatgccggaatcggtgctggtgcgcttcaaaggcaaaatgcagccgggcatcaccctgcgcgatctggtccatgccatcccgctgtacgccatcaaacagggcctgctgaccgttgagaagaaaggcaagaaaaacatcttctctggccgcatcctggaaatcgaaggtctgccggatctgaaagtcgagcaggcgtttgagctgaccgatgcttctgccgagcgttccgctgccggttgtaccatcaagctgaacaaagagccgatcgttgaatacctgacctccaacatcgtcctgctgaagtggatgatcgccgaaggctacggcgaccgtcgtacgctggaacgtcgtatccagggtatggaaaaatggctggcggacccgcagctgctggaagccgatgctgacgcggaatacgcagcggtgatcgacatcgatctggcggatatcaaagagccaatcctctgtgcgccgaacgatccggacgacgcgcgtctgctgtctgacgtgcagggcgagaagatcgacgaagtgttcatcggttcctgcatgaccaacatcggccacttccgcgcggctggtaagctgctggatagccacaaaggccagttgccaacccgcctgtgggtagcgccgccaacccgtatggacgctgcgcagctgaccgaagaaggttactacagcgtgtttggtaagagcggtgcgcgtatcgaaatcccgggttgttccctgtgtatgggtaaccaggcgcgtgtggctgacggcgcgacggtggtttccacttctacccgtaacttcccgaaccgtttaggtactggtgcgaacgtcttcctggcttctgcggagctggcggcggttgcagcgcttattggcaaactgccgacgccggaagagtaccagacctttgtggcgcaggtggataagacggcggtggatacctaccgttatctgaacttcgaccagctctctcagtacactgagaaagcggatggggtgattttccagactgcggtataatttgcctgacggcgtcaggcttaccatgcctacgcctcttattgcccggtggcggctacgcttaccgggcctacaaaacccatcgcaactgcggtgggtttttattttcattccgcctgctgttcccgctttttttcttctccgctgctgcgataatgactgtaagggctttgcagaggaacacattatggattacgaatttctgcgcgatgtgaccggacgggttttggtacgaatgtcgatgggccacgaggtggtcggtcactggtttaatgaagaggttaaagacaacctctcgctactggatgaagtagaacaagccgcgcgtacggtcaaaggcagcgaacgttcctggcaacgagcagggcatgagtacacgatctggatggacggcgaagaagtgatgattcgcgccaatcagctggatttttccggcgatgagatggaagaggggatgagttattacgatgaagagagtttatccctgtgcggcatggaggattttctgcgggtcgtcgccgcgtatcgggaattcgtcagtaaagcctgaccctctcttcgttattgccccgcaacgcctgtcgacggacagttgggggcggtagtggaaacgaaatcaccacacattccagccgggagtatcccggcttttttattgcagaatgattttttgatttttattaatcattttaaaactgtgatctgacgcgtttgtgatcttaatttgattgaatataatcgttatgattttattcaatcacaacaagcaacaggcggtaagaccatgaacatcaaaaaagcaatagagcgcgtacccggcggcatgatggtcgtaccgctcgttattggcgcagtcattaacaccttcgccccgcaggcgcttgagattggcggttttaccactgccttatttaaaaacggcgcggcgccgctgattggcgcttttctgctgtgtatgggagccggtatcagtgtgaaagccgcgccccaggcgttattgcagggcgggacgattacgctcactaagttgcttgtcgccatcggcattggcctgggcgtggagcatcttttcggcgcggagggtatttttggcctgagcggcgtggcgattatcgcggcgatgagcaattcgaatggcggactttatgctgcgttggtaggcgaattcggcaatgagcgcgacgtcggcgctatctctattttgtctcttaatgatggccctttctttacgatgattgcgctgggcgcggcagggatggcgaacattcccattatggcgctggtggcggtgctggttccgctggttgtcggcatgatcctcggcaatcttgatcctcatatgcgcgattttttgaccaaaggcggcccgctgctcattcctttctttgcttttgcgctgggggcgggcatcaacctggaaatgttactgcaaggcggacttgccggaattctgctcggcgtgctgacaacgttcgttggcggtttctttaatattcgcgcagatcgtctggttggcggaactggcattgccggggcggcggcctccagcactgcgggtaatgccgttgcgacgccgctggctattgcgcaggccgacccttcgctcgccgaggtggccgctgctgccgctccgctgattgccgcctcggtgatcaccacggcaatcctgacgccagtgttgacctcctgggttgcgaaaaaacaggcgcgtcaggcttctttggagaaaaacgcatgaaaatgatggttatcgccgatgattttaccggatcgaatgataccggcgtccagttggcgaagaagggggcgagaacggaagtcatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactccacatttcgcggcaatatcggcgccgaagtgacggcagctatgcgcgccagtcagcgaaaactggccgttatcgctgctgcgatccctgcggccggacgcacgacgcttgaaggaaaatgtctggttaatggcgccccgctactggaaaccgaatttgctagcgatccgaaaacgcccattgtctcttcccgtattgccgagatagtggcgttgcaaagtgagatccctgtgtatgaagtctttttacaggatgtccgacgcggcgggttaagcgccttacttacggcttatgcggctgagggcgaagggattatcgtcgtggatgcggtagaagagcgggacctgacgttgattgcgcaagcggcgtgcgaacaaccgtcgatgccgctgctcgtcggcgcagctggtctggcgaatgcgttgccggttgaactttttatgcaagaccggcagcggctaccggtactggtggtagccggttcgatgagcgaagccacgcgacgtcaggtggataatgcgctgtgccggggacgtgcggaggtcgtggatatcgatgccgcgcgcatggtgtcggatagcgcggagcaggaaatcgcgtctgtcgtagagcaggcctgcgcgctgttaagtcagcatcgacatacgattttacgcaccagccgtcgcgcagaagatcgacagttaatcgacgcgctgtgcgaaaaatccgcgatgagccgtcagcaattgggcgagcgactgagtcatcggcttggcgtcgtcacgttaaatattatcgagcaggcgcggattggcgggctgtttctgaccggcggcgatatcgctaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaaaaccgttgccattaccatgggcgatccagcgggcattgggccggaaattattgttaaagcgctaagtgaagacggtctcaacggcgcgccgctggtggtgattggatgcctcgcaaccttgaaatgtttacaggcgaagggcatcacgccgaacgtcgagttacgggccattgaacgggtcgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgactctgacccatagccgcgattacgcgatggtactttacaccgataaactaaaagtgattcacgtttcaacgcatatcgcgctgcgtaaattccttgatacgttaagtaccacgcgtgtcgaaacggtgattggtattgctgatactttcctcaagcgtgtgggttacgttaaaccgcgtatcgccgtggcaggcgtgaatcctcatgcgggcgagaatggtctgtttggcgatgaagagacgcgtatcctgacgccagccattaccgatgcccgcgcaaaaggtatggacgtttatgggccgtgcccgccggatactgtatttctccaggcttatgagggacagtatgatatggtggtggcgatgtatcatgaccaggggcatatcccgttgaaattgcttggcttttatgatggcgtgaatatcaccgcagggctgccgtttatccggacctctgccgatcatggcaccgcatttgatatcgcctggacgggaaaagcaaaatctgagagcatggccgtatcgatcaaactggcaatgcaactggcataattccctgttatgaaaggacaacaccgtctggatctcattgtggcgtatctgaaaaaccatacgctggttacggtagaacagctggttgaggcggttgacgcatcgccagccactatccgtcgcgatttgatcaagctggatgagcagggcgtgatcagccgtagtcatggcggcgtggcgctgcggcgttttgaacccgcccagcccaccaccaatgaaaaacaactgcgatcgcccgctgaaaaacgggcgattgcacgcgttgccgcatcgctggtcaatgctggcgatgccgtcgtgctggatgccggtacgacaatgatggaactggcgaaatgcttaacccatcttccgctgcgggtcatcaccgtcgatctgcatattgcgctgtttttagctgagttccggcaaattgaagtgacgattgtcggcggtcgtatcgatgacagcagtcagtcctgtatcggtgagcatgggcgcaagctgttgcgcagcgtttatccgaacatcgcgtttatgagctgtaattcatggggggtaaaaacgggcgtgacgaccccaacggaagataaggccgggcttaaacaggagattattgctaatgcgcagcgcaaagtgttgctggcggacagcagtaagtatggcgcgcattcgctctttaatgtggtgccgcttgagcgctttaatgatgtgattaccgacgtcaatctgccgccgtcagcgcaggttgaactaaaagggcgcgcttttgcgctaacgctggtgcagccggagtgacagcgccgtcaggcgctgccagtggtgaatcagaccgcagaaatattgcggccgtagtaaatctcgcgcatctctttccacagcgcggcggtgatctgctggcgttcggtttcagtgagatcttccggtttggtgtgaaacatatagtgcttaagatcgaactctttaagcagcatcttggtatggaaaatattttcctgatacacgtttacatccaccatgtcatacagcgacttcatatcttccgacataaaattctgaatggaattaatctcatgatcgataaagtgtttcataccgttgacgtcgcgcgtaaagccgcgcacgcggtaatcgatggtgacgatatcagactctagctggtggatcaggtaattgagcgcttttagcggtgaaatcaccccgcaggttgacacttcgatgtcggcgcgaaaggtgcaaagcccgccttccggatggctttccggataggtatgcacacagatatggctcttatcgaggtgcgccaccacggtttccggcagcgggccgggatgttcggtttggtcgataagtttcgggtcgatcggctcttcgctcaccagaatcgtgacgctggcgccctggggttcataatcctgacgggcgatgttcaggatgttcgcgccgataatggagcaggtctccgacaggatctcggtcagtcggttggcgttatagagttcatcgatataggcgatatagccatcgcgctcttctgcggttttggcgtagcagatatcgtaaatacaaaaactcaggcttttcgtcagattgttaaagccatgcagtttcagctttttcaatttttatcacctccttaacgtcactgtgcggacagtgcgtcatgtagatattgcggtagcgcaaatgcagcggcatgaatagccgagttgtaatagcggcatttgaggccggcggcatgaaaacgcgcctgaataatttcgctcgacaggtggcgaagagcgtcgttgtccgtcgcccaggcgaaggtcataatgccgccgtaataggtcggaatcgccgcctggtagaagccgacatcgctgaagtaatgactcagcttgcggtggctgtcgagcgcttcatcctgttgcaggaagcacacgccgttctgggcgacaaaaatgccgcccggattcaggcaacgcttacagccttcataaaaggcggaggtaaacaggctttcgccggggcctatcggatcggtacagtcggaaatgatcacatcaaaggtctgatgggtctgattgacgaaattcacgccgtcgtcgatcaccagcgtaaagcgcggatcgtcgtagctgccggcattgtggttgggtaaatactggcggcaaaacgagactacgccagcgtctatctctaccatggtgatggtttcgacgtttttatgccgggtaacttcacgtagcattgcgccgtcgccgccgccgataatcagaacgtgtttcgcatgaccgtgcgccagcagcgggacatgggtcatcatttcatgataaataaactcgtcgcgttcggtggtctgtaccacgccgtccagcgccatcacgcggccaaaagcggcgttttcaaagatgattaaatcctggtgatcggttttttcatgatacagaacgttgtctacggcaaagtactgaccaaactggtcgtgtagcgtttcatgccacatcgtattttcggccattggctgatacctccattgttaacacccgtaaaaaaagggcgcaacatcatagctaacaatgaccgtggatgcacggtcattatttcagcaataggatcgcggaggattatttaacgtaggctaacaggctcagagaatcgcgggccagagctttgcattttttagcgaccggaataccgatgccgctaagatcgcggtagctgtcttcgcccaacgatttcatatcgaaggtgtcgtagttactcaggtcccactgattttgctgggcaaaaaagaccagcgcacggcgaatctgactgttgggtaaattttggtaaccacagtcatttttcagaaaaacgaaaaccgccgttaaatcggccatatcttcagcttcggattcagtaagcgcatagctatttgcgcataaggccatcaggctgccaaacaacacgggtctgaaaaacgtcttcattgcttctaccacggcatcagggaaagtcaacgttagcatactgagaacgtagcgacgacttttattatcaggattggtcgcggcgttttcattcttgttgtattgctgtcaggaacggtaaagacgtgttgctggcttgaccttcccgttagggcagggtctaagcttagacacccgcctgttcattataaggaaatgattatgttacgccgtgatttcttaaaatattcagtggcgctgggggttgcatcagcgctgccgctgtggagccgcgccgcttttgccgccgaacgtcccgcgttgcctattcctgacctgttaacggcagatgcgagcaaccgtatgcagttaattgttaaagccggacagtcgacattcgccggtaagaacgcgacaacctggggctacaacggtaatttgctggggccagcggtacagcttcacaaaggaaaaagcgtgaccgttgatatccataaccaactggccgaagacacgacgcttcactggcatggtctggagattccgggcatcgttgacggcggcccgcaggggattattcccgctggcggaacccgcacggtgacgtttacgccgcagcaacgcgccgcgacctgctggattcatccgcacaaacacggcaaaaccgggcgccaggtggcgatgggcctcgccggactggtgctgattgaagatgacgagattcgcaaattgcgcctgccgaaacagtggggtatcgacgatgtgccggtgatcattcaggacaaacgcttctccgccgatggccagattgattatcaactggatattatgaccgccgccgtcggctggtttggcgatacgctgctgaccaatggcgctatctatccgcagcattccgcgccgaaaggctggctacgtctgcgcttgctgaatggctgtaatgcgcgttcgctgaatatcgccgccagcgataatcgtccgctttatgtgatcgccagcgacggcggcctgctggcggagccggtgaaagtcaccgaactgccgttattaatgggcgagcgttttgaagtgctggtggatatcagcgacgggaaagcctttgatctggtgaccctgccggtcagccagatgggaatggcgatcgctccgtttgataaaccgcatccggtgatgcgtatccagccgctgcggattaccgcctccggtacgctgccggatacgttgacgacgatgccggcgctgccgtcgctggaagggctgacggtgcgcaacctgaaactgtcgatggacccgcgccttgatatgatggggatgcaaatgctgatgaagaaatatggcgctcaggcgatgagcggcatggatcatgacagcatgaacgcgcatatgcagggcggcaatatggggcatggcgagatggatcatggcaacatggatcacagcgggatgaatcatggcgcgatgggcaatatgaatcacggcggaaaattcgacttccataacgctaactttatcaacggccaggtcttcgatatgaacaaaccgatgttcgcggcgcaaaaaggccgacatgaacgttgggtgatttccggcgtgggtgacatgatgctgcatcctttccatattcacggcacccagttccgtattttgtcagagaacggcaaagcgccagcggcgcacagaacgggctggaaggatacggtacgcgttgagggcggtatcagcgaagtgctggtcaagttcgatcacgacgcgccgaaggaacatgcctatatggcgcactgtcatctgttagaacatgaagatacgggaatgatgttaggatttacggtctaatcgatgtctgtgacgcaggccgggtaaggcgaaaccgctacccggcacaatgcccggcatacgccgggcattaatggttatttcgcgtcgtcaggcaaagcataggccacgatatagtcgcccatcttcgtaccaaacgaaccgtggcctccggcagaaatgaccacgtactgcttaccgtttacctcataggtcatcggcgttgcctggcctccggcgggtaaacgtccctgccacagtttttccccgttgctcatgttataagcgcgcaggtagttgtcggcggtcgcggcaatgaacagcacgttaccggcggttgagattggcccgcccagcatgggcatccccatgttgaacggcaccggaaccggcatcgggaacggcatactgtcgcgcggcgtccctatacgtttcttccacacgatttcattggtcttcagatccaacgcggaaatgtagccccaggccggttgtttacacggcaaaccaaacggcgaaaggaacggattcagcgtgacgccgaacggtacgccgtactgcggctgaatacccgcttctgtaccggtacctttcgcgtctttcggcggttccattggattacccgggccgcgtgggatcagcttcgagacaaacggcagcgccatcgggttagcgatagcgacctgacggtctggatcgacggaaataccgccccattcaaacatccccaggttgccagggaataccaatgtcccctgctcggatggcggggtgaagataccttcatagcgcaactggtggaacataacgcggcacaccagttggtcgaacatggtcgcgccccacatatccgcgccggagagatcttttttcgggcggaaggttaaatcagagaacggctgagttttggcgacataatcgccttttgccgcgccctgcgggaccggtttttccggagcgggcacgaccagctcgccattacgtctgtccagcacaaagatattaccggttttcgctggtgcatagataaccggaacggtagtaccgtcaacggtaatatccgccagcgtcggctgtgccggcaggtccatatcccacagatcgtgatggacggtctgataactccaggccagtttcccggtggtggcattcagcgccaggatggagctggcataacgttcctgctccggcgtgcggttaccgccccagatatccggcgtggtcacgcccatcggcagatagaccagatccagtttcgcatcataggcggcaggggcccaggagttcggcgagttaaaggtaaaagcgtgctcatcggctggaatcgtgttcggatctttcgccccaggatcgaaggcccacagtagtttaccgctattaacatcaaaaccacggataacgccggacgtttcgcgagtagagaagttatccgtgaccgaaccggcaatgacaattgttttatcggtgataatcggcggcgacgtcggttcatacagtcccggcgtggtatccggcatattggtttgcagattcaggacgcctttgttggcgaaggtttcacacagcttgccggtttcggcattcaccgcgaaaaggcgaccgtcgttgaccgggaggataatgcggctcggacagtcggcgatgacctccggcgaggcggtatccgctttggcctcatgataagagacgccgcggcaggtcacatgctggaaagacgaatcggtcttcaactgaggatcaaaatgccacttctctttaccgctggcggcgtccagcgcgaacagacgctggtgagctgtacacagataaagcgtatcaccgacttttatcggggtcacttcgttggtgatttcacccggatcgttgggttgtttcagatcgccggtgcggaagacccacgcttctttcagttggtgaacgttatccgcagtgatctgtttcagcggcgaatagcgttggccttcctgattacgtccataggccggccagtcttcgtcggcgatcgacgaacttgttgcggcgggcgtggcgtcggcgcgaagcgtaccgttgatctcctgcgggtcgttgaagccagcccaggtcagaatgccgccgctaatcagcagcgccacgaccagcgccgccactgcgccgctggaaggaaccaccagccgatgccagacaaacggcaatattagccagatgccgaaaaacaccaggatatcgctacgcggcgtgagtgcccagaagtcgaacccgacttcccacacgccccaaatcattgtcgccagcagcagggcggcatacagccacagtgcggcacgtttactgcgccatagcaatccggccacaaccagcatcacgaggcccgcgatggggtagtaccaggaaccgccaatagcaaccagccagacacctccgataagaagatacagcccgcaaagtgctgcaaagagggccgtcagcgtcacgagtaatcgtggcgatcgtgcgttattttctgccataaaaagacaccatcccaaattgttaattttttagtagcaattaagcataggaattaacatgtgtgatcgtcatcacaaaatgagctttcttatcaaatgccgcgaatgaatacgtttgctgttatactgcgtgccttgcgcgtcaatgcggcgttattagtcaccggcattgagtgatttgtttttaaatcatatggttataaatatgaaacatactgttgaagtcatgatccccgaagcggagatcaaagcacgtattgccgagctgggtcgtcagattaccgaacgttataaagacagcgacagtgaaatggtgctggtaggtctgttgcgtggctcatttatgtttatggcggacctgtgccgtgaagttcaggttcctcatgaagtcgattttatgaccgcctccagttatggtagcggtatgtccaccacccgcgacgtgaaaatcctcaaagatctggatgaggatattcgtggtaaagacgtgctgattgtcgaagacattattgattccggtaatacgctgtcgaaggtccgtgaaatcctgggcctgcgcgagccgaaatcgctggcgatttgtacgctgctggataagccgtctcgccgagaagtggacgtgccggttgagttcgttggcttttcgattccggacgaatttgtagtcggttacggtatcgactacgcccagcgttatcgccatctaccgtatgttggtaaagtggtgctgctggacgagtaagcgcagaaatgccggatggcgtcgctaaagcgacttatccggcctatagctaatggcttattggtggggaatgtatttcagacttagggcggagatacccttatgatagccgttctccagcgtttctctgttggtggcggtgacgtcaagatcgcgcagcaggccatcattgatactgtacgcccagccgtgaatggtcacattctgcccgcgtttccacgctgactgcataatggtggaatgccccaggttatagacctgctccatgacgttcaattcatagagcgcgtccagacgttgctcttcgggcatttttcccaacagcgagctatgtttaagccagatgtcgcggatatgcagcagccagttattaatcaagcccagctcagggttttctaccgcagccttgataccgccgcaaccggagtggccgcaaatgataatatgctcaacttccagagcatctaccgcatactgaaccacggagagacagttcagatcggtgtgaataaccaggttagccacattacggtgaacaaacaattcgcccggttcaagcccggttaaacgctctgcgggaacgcggctgtcggaacatccaatccatagaaagcgcggtttttgcgcttgcgccagtttctcaaaaaatccggggtcctcttccaccagcatttttgaccatagtgcattgttgctgatgagtgtatctatgtctttcatggaagttaacgacctgtaaccaaataagtgcgttgggctaatatagggcaactccgtaattatttaaaccatatataaagtgtaagaacgtaaagtaagtgagaatttatgaccattgcgctggaacttcaacaacttaaaaaaacctatcccggcggcgttcaggcgctgcgcggcatagatttgcaggtcgaagcgggggatttttacgcgcttctggggccaaatggagcagggaaatcgaccaccatcggtattatcagctcattggttaataaaacgtccgggcgcgttaacgtttttggttacgacctggaaaaagacgtggttaacgccaagcgacagcttggactggtgtcacaggagtttaactttaacccgtttgaaacggtgcaacagatcgtagtgaatcaggcgggttattacggcgtggagcataaagaggcggttttacgtagcgaaaagtatttaaaacagctcgatctgtgggaaaaacgtcatgaacgcgcgcggatgctgtccggtgggatgaaacgccgcctgatgatcgcccgcgcattgatgcatgagcctaaactattgattctcgacgagccgacggcgggcgtcgatatcgaattacgtcgctcaatgtgggggttcctgaaagacttaaacgccaaaggcaccaccattattctcaccacccactatctggaagaggcggaaatgctgtgccgcaatatcggtattattcagcacggcgagctggtggaaaatacttccatgaaaaatctgctttcaaagctgaaatcggagacatttattctggatttagcgcccaaaagcccgctacctaagcttacgggttatcaatatcgtctggtggatacctcgactctggaggtggaagtgttacgcgagcagggggttaacagcgtctttagccaactgagcgagcagggggttcaggtattaagtatgcgtaataaagccaaccgtctggaagaactgtttgtgtcgctggtgcatgaaaaacaaggagatcgcgcatgatgcagctttactgggttgcccttaaaagcatctgggcgaaagagatccaccgctttatgcggatctgggtgcaaacgctggtgccgcctgtcatcaccatgacgctctattttattattttcggtaacctgatcggttcgcgcatcggcgaaatgcatggctttagctatatgcaatttattgtgccgggcctgattatgatggcggtcattactaactcctacgccaatgtggcctcctcgttctttagcgccaagtttcagcgcaatattgaggaactgctggtcgcgccggtgccaacgcacgtgatcatcgccggatttgtcggcggcggcgtggcgcgcgggctgtgcgtggggattctggtgacggcgatttcgctctttttcgtgcctttccaggtgcattcctgggtatttgtcgcgctaacgctgattctgaccgcgattctgttctcgctggccggactgctgaacgccgtgtttgccaaaacctttgacgatatcagtctgatcccgacctttgtgctgacgccgctgacctacctcggcggggtattttactcgctgacgctgctgccgccgttctggcaagggttgtcgcacctgaacccgatcgtctacatgatcagcggtttccgttatggttttctgggtatccatgatgtgccgctggtgacaacgtttggcgtactggtgatctttatcgctactttctatctgctgtgttggtcgctgatccagcgcggacgcggtttgcgtagctgatacgattctcctcttctcctggagggaagaggagacttttgacggctgtcatcattcccgattgatcaccctgataaactacttgcctgctaaggaggtaggttatgttaggttgggtgattacctgccatgacgatcgtgcacaggatatgcttgatcgcctggagagaaaaaatggtccgctggcgcaatgccgggcggtcaatttttggcgcggtctgagctcaaacatgctgagccgcatgatgtgtgatgccctccatgccaccgattccggtgaaggcgtgatatttttaaccgacatttccggcgcggcgccttatcgtgtagcgtcgctgatgagccataaacatcctcaatgtgaagttatttcaggcattagctattcattgatagaggaaatgattcctttgcgagagtcgatgagcagttcagcatttcgtgaccagattgtcgcgcttggcgcgccggatgtcaccagtctctggcatcagcagcagaaaaatccgccttttgtattgctgcatgatttgtatgagttttgatcaataccattgacgacgcttttgctacaataacggcgttttttcgcctcggttatgatatatggttatgcgtgttgttcttatcttgctgttctttttcgccggtaatgtgttggctgccttgcccgctcgttatatgcaaacgacgaaagatgccgccatctggtcgcagattggcgacaaaatggtgaccgtagggaatatccgcgccggacaaattctttccgtaacgcctgttgcggttgattattatgcctttaaatttggcttcggtgtggggtttatcgataaaggccatctgggacccgtgcagggaaaacaaaaagtggaagatgggctgggcgatcttaacaagccgctcagcaatcagaatctggtgacctggaaggacacgccggtgtataacgcgccggacatcagtagcgccccgtttggcgtattggtggataatttgcgttaccccattattagcaagctgaaaggccggctacatcaaacctggaatcagatccgtattggcgacaggctggcttatgtcaacgccatggatgcgcaggaagacaacggcattccgattttgacctatcatcacattttacgtgatgaagagaatacccgttttcgccatacctccaccacgacttcggttcgggcattcagcaaccaaatgacctggcttcgcgatcgcggctatgccacgttgacgatgtaccaactggaggattacatctataaccgcgctaatttcccggcgcgcgcggtggctatcacctttgatgatggccttaaatcggtgagtcgctatgcatatccggtattaaagcagtacgatatgaaagcgacggcatttattatctcatcgcgtattaagcgccatccgcaaaaatggaatcccaggtcgctgcaatttatgagcgtgtccgaattgcgcaagataagcgatgtttttgattttcagtcgcatacccattttttacaccgggtagacgggcatcgccgcccgattttatatagccgcagttaccataatattctgtttgattttgaacgttcgcggcgggcgctcacacagtttactccgcacgtattttatctttcttatccctttggcggctataacgcgaccgcgatcaaagcagcaaaagacgccggtttccatctggcggtcaccacggtgagagggaaggtgaagccgggagataatccgatgctgctcaaaaggctgtatattttacgcacggattcgctggaaacgatgtcgcggctgatagtcaatcagccgcaggggtaaggactatcaggcaacctgaaccggaatggctttcgcggtgcgcttcatttcgttgtcgccttcaaagtaggccactttcggacgccatgtacgcgcttcttcatcagacatggtgacgaagctggcgataatcacaatgtcgccaacttcagcgcagtgcgccgccgcaccgttcaccgagatgattctggagccgcgttcagccgcaatcgcataggttgagaaacgtttcccattggtcacgttccagatatcaatcgcttcgttttccagaataccggaggcatcaaggaaatcctggtcaatggcgcaggagccttcgtagtgcaggtccgcctgcgtgacttttacgcggtggagcttgccttgcagcatggtgcgaatcataacttctataccctgtcgtttatcttggctaagcaggcgcttgtagcctgctttggaaattctcaggcagtattgcccgatttttaacccctgtctactgggctaatgtaacgctttgattatcgatcagacgcgcctgtcccagccaggcggcagccagaatcactgcgcgtttgctggtttccgtcagctccagcagcgtgtcggcatcacggatttgaatgtcgtcggcacggaagcctttttcattcagttcctgctcggcaatggcaataatctcttgcagctcacgattacccgcaatcagtttttcagcgatgctattcatcacgttgtatagacccggcgcaattttgcgctgctctgcagtcagataagcgttacgtgagctgagcgccagaccgtctttagcgcgaataatcggcacaccgacgatctcaatgtcataacccatatccgccaccattttgcggatcagcgccagctgctggaaatctttctcgccaaagcaggcgatatccggctggataaggttgaacagcttgctgacgatggtcgagacgccgcggaagtggcccggacggctggtgccttccagcatggtagagaggccgggaacgtcaacgtatgtctgtccttccagcccctgagggtagatttcctcaacggctggggcaaagacataatcgactttgcgtttgttcagcttttcacaatcttcctgcaacgtgcgcggatagcgcaccagatcgtccggccgatcaaattgcatcgggttgacgaaaatgctgacgatgaccacatcggcccgggcttttgcctcatcgaccagcttcatatggccgtcgtgcaggttgcccatagtgggaaccagtgcgacgcgtttgccttcctgacgcagacggcgaatatgctggcgcagcagcggcagggtttcaatgattaacacaacaagactccttgagttgcttgatgatccagcccgatggcgctgcgcttatcaggcctacatccgttgaggatctgtaggccggataagacgcttcgcgtcgctatccggcacggtcagaaaaattagtgaaagctgtgttcttcgcccggataaacgccggactccacttctgccatatactgccgtacggcggcgcgcatgtcgcccgcctcggcaaggaaatttttcgcgaattttggaatatgaccgccggtgatgccaaacgcatcgtgcatcaccaggatctgaccgtcggtgacgttgcccgcgccgatgccgatcaccggaatcgacagcgcttccgtgacgcgcttcgccagttcaaccggcacgcactccagcaccagcagttgagcgcccgctgcttctaaggccagcgcatcatccagcagtatctgcccggcatcgccgcggccctgaattttatagccgccgaagatattcaccgactggggagttaatcccagatggccacacaccggcacggcgcgttcggtgagcattttcaccgtatcaaccaaccatgcgccgccttcgattttgaccatgttggcccccgcacgcatcacgatagccgcgttttcaaacgcctgttccggcgtggcgtaagccataaacggcaggtcggagagcagcaggcagttcggcgcgccgcggcgtaccgcgcgggtgtggtaggcgatatcttccacggtgacaggcagggtggagtcgtgcccctgaattgtcatgcccagcgagtcgccaaccagcatcacattgatgccttcatcggcgaagagtttggcgaagctgtaatcgtacgcggtaatggtggcgaagcgctttttctcttgtttgcatttctgcagcacagcgatagtagtgggtttgctcataacctctccggccataatattgatgaatagaatggccgcattgtaggggaagagaaccgcaagcgttagccttttctgggcaaattgcgttgcggttcgttataggattttacggataggtgattgaaaattgagcggtggctttgaaatcacctggattgattgttggattgtcaccatcgggctttaaggttgcctggaaatacaacgattttgtcgcgcttcctaccgggctgccgtctccggtgttattggtggtatctttataaattgagcttgagtcgttaggtttgagtaccatctgggcgctcgaactacttttcaaaccttcaattaaaacgccaatgccgctggctttcgtgttgctggttgaattgttggttagtagcgaggtgtttttcgtcccgacattattactggccaatttaacttcaatattattgatgtactggcaggaggagagattgatctggaacttggtcggcgacagcccttccataatctgctttggataaaagctacccagcttaaccgttgatcccgaaacattggtgccgctaatggtgctggccgagcaggttggccagacggccttaagtcctgtggcggcgaggttaaacttcattttatagtttgataatccgctgcccgggttatcaatgtagaaatcggagtcgccgtttttagacagcgtaaagctttgaagctgggcttccgtcggcgcgaagtcagagtcgacataggcatagattttcaggccatacattaatttgccaaggttgctataaacatttgttctggagcaggctgacggaaattccgtgaactcgctggtgatcggcgttgaggtcttatcaaaccagaaggtgcttgaggtcatattctctgctggctgaaggaaggtcatctcaatggtgaaataaaaaccgggaattgaggttttatacagcggatgtccattatagcttttgccagcagagatataattatgggtcagttgaaggtaggtgtggttgccgctgccgttacagaacatctccataacgtactggatgccggaccagttaaaaacggtaatctggcgcagcgccgtttccttatgaatcgcgatggtctgcccaaaattgtggctgttatcagtgaataccgaatccccgcttgggccatcatgttcactggaggcgtagtcgccaacggccagggtagtatttatggcataacagttggacatgatagccatcatcaggaaaaaggcggcaaaccatgttgtgttttttaaaagcatattaacgatatcctttcgtttaataaaatctcctgattattcataggagacattcaccagtacacggctgctaagttcaccggtcgtcactttttcggcactgcgtattttttgcattctggagtaaaaggtccagacggtgtcgctgtaggtgctggcagcaaaagtcgcccgcgatgaaccatccgtattaagcacgttggtgcgtggtgaatcggtggtgaaaatcaccacgccgacattgtctacgccaccagcatcggtagcgatgtcattaggaaaaacttgttgattctcaggtgagaactgcccgtttagtggtgcgaaattaaaggtgacattggttattttaccatcactgatcgggcaagaaataagcttaatggtgaactctttccccccctcataatcggtttccgcggtaatgccatcggcaaaataggcgggcgctatggtggcgaagtttaccgttccattgccatctatctttatctggcaggtgtccttctgcacgctggcggtgaaattcacattggtatcggcgtacagcgtcgcgctaaacagggctgttgccagccctgaaaataacgtggcgagcgtgggttcgcgcaaacgtctcattggtatcaccattactggtaagtgatggtgaaggtggtgggcgagtagaaatctcccgctgtcatattttgaagcgtaccgccgctttgagcgaccatcatagcgcttaaaggaaaatcaacaggcgttgttacacttgcaccagataaatccacggtttgttctggtttcgaccagcagtgaagttttaccgcgccagtgcctccaggggtttctgtcgtccatacttccatggcgaccattgctgcctttgttgttgaagtcgaggcatttgcgaattgcccatcagtgccgctgctccccgggcatgctacattatttggggctagtctgaacttagcttttttatctttgagaccgacacaatcactgaaccgtaacttgaaaagttttattttactttttgcatatacttcagaaatgtaaacgttgccaaaagcgatagtatcggtaatggtatcaccttcaaccacggatgcagaacacgtacccgcagtgatattggcgttcacggtcaggtccagactgttggttccatcggcatatgtcatcgttgatatgccagctcccgtggcaatcagcgagctaaaaatcacgacgcgcaatatttgctttttcattatcatcgtccttgttattgataagtgaagttaaacgtagcggttgagctgaaagcacctgtggtacccgcgccgtcggtcagttcacgcagcgcgaccgtcatttccacttcgtttgctgcgcgctcgtcggaagtccagctaaatgagcctgagccgggcgtgaaataggtttcatcggtagtgcttttgcgcttaaagcccatgccaacattggtggcagcgccgcttgccgctgattggtttttgataaaattgccgctggcatctgtggagctggcaagcgtggtggtgattttggtcagagcggcactgcaatccttcgcgacaaacttaaagtttttctgcgattccgctgatttttttataattttatccaacccgacatcgccgacgttcagcgtatagccgctggtggcatcacccgataagttcgagccatctaacgccgcaattgacatgctgcaggtcgtggctaacacggtggcggtaaagtcgacgttgatattttccgcctgactggtaagcggaaatatcacggcgagcacagaggctgctaaaaggtatttattccttttcattgtctattccatttgatttaaggttattaacacgacaggttatgtggtctaacagtaaggtctggctggaccctaccgtttgttgcgttgccggcaacgcaaaggttgctaaacaagttgctggctggttttcttcaaaccagcgtactgagagttcgcctgcatcgctgatgccgcgaacaaaagcctgaccgccctggcccatgttgtcgatctgcacatcgttctcgtagacttctgcgccaaatggtagggcttttccgtcattacgggacatgttgagaatgaccgagcgtccctggtcagtttcgaaactggctaagactaccgcgccatcacgcggtatcagggttgtactggtgctctttagttcgacatcgttttccagcgtgtcgatatcaatattgacctggttttctctgtaggcggaaagcgagttcgtcgcgccgtagccccagcgatcgatggtgctgttgccgccattgatgcgcgcgcctttcgcgccaggggcttttaccagcacgatggcatcgctattaccgaagttatcgttagtgaacgtcactccaccgccatgcaggacaaagtctccggttgtggcgagcgaatattgtcggctgctgtcattattggcagaggctgaagcagtaacatctccccagggggactgatagctggcgtagccgctgacatcggtgatgttcttttcatttttctgcatggtgtagccggtgttaacgctgtagttcagcgtgtggtcttcactgctgccgttgctgttcatgctcaactggtacccgccgtcaaaatcagtgcgcatttgcgccgtcagtgagctgaaacccgacttacggcgaccgccgcccagcagattctccagcggaacgttgaagttgatatagagcgaatcatctttttcgccatcttcatcccaggatctctggaggttgatactgaggctgccccacgaaaaacctcttccgtaaccgaggctatagtcggtacggctttcattggtagcccagtagtcggtccaggagcctgagaggaaaaaggaaccgtagtcgacttccttaaacctcaacggttggtttatgctgaccgtgacctggtttttcatgcgcgaatagttaagcatggtgttgcgatcgtccgcgtctttatgtttcgcgtcatcaatcagctgtagcgcatcattcaggcccaggtagtcctgcgttgaataacgatatgccgctacgttaaaggaggttgccgtcggttcaatcagcttgttccacgtcagtcggtagctctggcccttataggttttatcctcagggatctctgtacgagactgagtgacatcaagtgcaaatgcgccaagaggggtgttgaggccgacacccagcaacccggcaagatagttattatctgttccctgaacacctgtatagagggtcaaaaagttattaaggccgtagtaatatgaaccttgcgccatatagggcttgtcatgaagctcatcgtcattcacttcaccggcgctgaaatcccaacgtccgacgcccgggcgctgcatctgcataaccgaggagaatggctggctaaaggtgcgtttactgccgtcggcctcctcaacggtgacgatgaggtcgctaccgtagccggaaggactgatgtcgctgatttcaaaggggcctggcggtaccgtggactcataaattttgtagccgccctgggttatgctgaccttggcgttactgtttgctacgccgcgaataatcggcgcatagttggcaagctgcgaaggtagcattcggttgtcgctatacagacgagccccgcgaatgcttacggagtcaaatgtttcgcccgtggtataggtttcaccgacaacaagttgagagcgcattgaaggcagatcgcgctgcaagtagcgattctgatagtcaaaggagcttcctgagtctttcgtccagttatagttgccgttggcgcgaaaacgccatgcgccgaggttaataccggtgttaaacgccgcatacatactgtcattatcggcgctgccattggtgctgtgatagccgttagccgagtaggacagaagcgctgccggaataccatcttcccacagcgaaggctcaacatagccgtcataaccttcaatgagccacgcctgaggtacggtaatatccagacgctgttcgcccatatcaaaattgacctctgaatgcgcgatggcgacgggaaggttcagacaatcttgatcttcttcctccccttttttcagaatttgattggtcgcattgatttctggctgtttgatatgcaactgcgccagatttttttgtgtcaggcaggcttctgcactgaccttgccgatatcgataaagggtatggacaggcttgatacggggttttcgttgacaaaaactttcacgctatacgttccgacaggcgttgggttgccgtcggagtatttgctgatatcgattgtggaggcgctactccccattaaaaaggaactgtcgtattcaacgctttcagcggaaatactgctctggctataaaatagcgcacagcaaactgcgagcatcgttttcttcggcatggccttggaatgtggaaagttttacaccgatttcttcatcctgattcttggttaatccgttacagcgatacggaaccttcaatcaaaccgccaaaatcattaatggcgtgatactccagttttccggcgctagcgcctgacaagcctttcacggtgaaggatgatttactgaaaggcgcaaccatggtggcttcaacgtcataacgtttaccgcctgcagtgtaggtagcgtcattaaatgagacgaaatacggagttgagttatcagcacgtagtaccgcgtagccttgttcgctcgctatttgccacttcagttgttttgccgcttcagcaggctggccttttagtcctgttgggcgatagaacagtttgatacgggtacgaaaagccagttgcagtaagcttttattctcttctttgctggtatccgcttttggcggtacttccagtacgttaaaccagaagacgctttcccggtctttcggcagcgcgctggcctgggtatacataatttttaccgattgcccacgtttaggctcaacgcgtgaaaccgggggggtagaaacgaaaggcgctttaatactcccgggatcgtcgttatcgttacccaggtctatccagttttggactaataatgggcgggtacccttattttccagtcgtatactgacgtcttttttattttcgtcataaacgattctggtgcccgagataataatatccgcatagctaaaggtactaaatacagcactggctaatacgatggcggtcaggcttttttttacatacaacataagcgttccttgcctgtagaagataatgaaatcaactttgaatttaattaaattgaatgaacccccggaatcgttgaaataattcctggaccccgaaggttatatgagatcaataactgataagcacgctaactcaaggaaaggtacgagtacttattagtgataaccgtatgtcctgttactggtaagtaaaggtatacattgcgttcgtggttacatgaccggtagtcacttctttagaagcatcggcacgaacgtaagacgccataaagttataggttgcaactttgtttttgaaggacgcttcatgaatttcagcgccatcgattttaacctgagttttggtatcggcatcatggatggcgatattcacgttttcagccccagtttcaccagccacggacagtgtggtgtcattgtcaagagtgccggtagtgttagagaatgacgaatccattaccagagaagccttagtggcatcagttacatcagccgcgcctgagcaatccaggatgatagagaacggagccggaagcgcgccgtatgcgttagcagcaacgccttcagtgatatcgcctggggctgctgtagtcagatatacgtcaccatcagtcgcttgattaccgcgtgaagaggaaactactttagaacaggttgttgcgctcactaaaccgtggaattcgatctggccgccttcaactgccattgcggaagtagaacccatagccataaccattgcggcagctaaaatcgcttttttcattgctgtatccttacaggattgaaatgttaataaattaaatatctattaatttatattaaatagcagggcttggattttagcgtttgaggataatttttgtataatatttattatttattatttattgttttttgcgatgaattacctctgattatatttaaggatattctgacattttattcattgtgttattaatagtgttattcatggtgtgtatgtttaattgcattaagcggctgttttttaaacggatagctgaaatatatggtttgttactatgttatataatatacgactggttccatgattatttctaacaagagtatttaatttatctaattatacggaataacagcatagaaactatttgttgaattgataataggggtatttcttaccaacgatcgggacagggagacatttgggacatcagctcgatcagcagacctttatcgtcgggaaacaccagctccggagcgatttcgaataacggccacagcataaaaccgcggtttttcatgtcgtagtgcggcacggtcagacggtcggtgttaatgacttcatcgccaaacagcataatgtcgagatccagcgtgcgcggcccccagcgttcgaccttgcgcacccggccctgttgcagctcaatgcgctgggtatggttaagcaattcttcgggggcgagagcggtatccagcgccaccgcagcgttcaggtaatcgggctgatcctgtgggccaagcggcggcgtgcggtaaaacgaagaaaccgcgacgatacggctatcgggaatgtcggcgatagccttcagggcggcattgacctgctccagcggagaggccagattactgccaagcgcgatatacgcgatcgtcatacggtgccctcgcggcgcggcgcgcgtttgcgcggacgtgaacgacggcggcgtggagcaggatcgtcgtccagctcgttgagcatccctttttgttccggcggcgcggaagcctgaaactcggcccaccactgcgccagacgttgcagttcagtattattttccacttgggcgcgcagctccagcaaatcaaacgcggcgcggaatttgggatgttccatcagcttccaggcgcgtttgccctggcgtcgcgacatgcgtaactgaagctgccaaatatcacgggtaagcgtggtaaggcgtttcgggatcgccagtgaacggcaggcttcatccagcacgtcattcatggccagcgcgaaagcatcgtaataggcaaggccgctctcctgagcgattttttgcgccatctccagcagcggataccagaacatggcggcaaacaaaaatgccgggttaacgcgcatctcgttacggatgcggttatccgtattcttcaacacctgcgcaatgatgcgttccattgcgctgtcgccgttttcggtgaaataacgcgtaatggtaggaaacaacggctggaagaggtggtattcccgcagttgttgataggtttcaaaaccgttccccgcctgcaacagcttcagcgattcttcgaacaggcgcgcgggaggaatgtcgtttagcaaggttgccagacgcgggattggctcagccgtttcagggctgatacgcatattgagcttcgcagcgaaacgcacggcgcgcagcattcgaaccggatcttcgcggtagcgcgtttccggattgccgatcaggcgaatcacgccttcttgcagatcctgcatcccgccgacgtaatcgcgcacggtaaaatccgccacgctgtagtaaaggctgttgatggtgaaatcgcggcgctgggcatcttcttcgatagagccgaagatgttgtcgcgcagcagcataccgttttgcccacgctgggaggtcgtacggtcgctttcactgccttcattatgaccacgaaacgttgccacttcgataatttccgggccaaacatcacgtgagccaggcggaaacgacgccccaccagacggcaattgcggaataatttccgtacctgatccggtgttgcgttggtggtcacatcgaaatccttcggctttttaccgagcaggagatcgcggacgccgccgccgaccaggtaggcttcatagcccgctttgttcagcctgtacagtaccttgagggcattttcactgatatctttgcgggagatagcgtgctgttcacgcgggataatcgtcatatgtggacgggcgacggcttgttctgcctcgctctcctcgcggcttaacaccttacggcaaaaattagcgactcgggtaaaaatagcgcacctcggtagtgtcatacattaataagatcaacttactctatgtctttcgcattacggcagacgggcgtaagagagcaacgcgacctgggctgtaagcatcattaacgccgcagcaatgcgaaagacgatgagcaaaaatagcggctaatcatagctcagcgagacgcatttgagaatgccggatttacattagccgatgtgggtacggctgtaagcctccagtgcgccaccgcaaagcgcagcaactcctcaacagacatctcctgccacgctacgacgtcgcgttggcctaaaaagcgcaatgcctggaccagtaccgggcgcggatcgcctgtcgcaagcgcaggggcatgattttgcttggaaagtttagcgccttgttcgttgagcgccagcggaaggtgcacgtaacctggcgcacgccagccaaactgtttatacagcgaaagttgtcggacagtaggttcgattaaatctgcgccgcggacgatctccgtcaccccctgaaaatgatcgtcgaccaccacggccaggttataagcaaacagtccgtcgcggcggtggataataaaatcttcgctagccagctgtgggtcagcctggatgtcgccgcgcaaggcatcatggaaatgcatcactggatgctgctgtttaattctgacggcggcattctccggcccgtggcataacgtccggcaatggccatcgtaaataccgcccagacgttgaatgcgcgagcgggggcaagtgcagtagtagctcagtccctgctcgtgaagccaggccagcgcctcgcgataagcctcatgacgctgtgattgccataagacctcgccatcccagtgcaggccgtaatgttccagctggcgcagaatggtcgctgcggcaccgggaacttcacgtggggggtcgatatcctctatgcgaacgcgccaaactccgcgttgcgcacgggcttgtagatagctgccgagggcggcgattaacgagccgaaatgcagttcgccggatggcgacggcgcgaaacggccaatatagtgtgagtcagtcatgctgcgggcaataaagaataaggcgggaaaactcccgcctgtcataaatagggtagaaacgaacgggattaacccgccatctgtttttcgcgaatttcagccagcgttttgcagtcgatgcacagatcggctgttggacgcgcttccaggcggcggataccaatctccactccgcaggactcgcaataaccgaagtcttcatcttccactttcttcagcgttttctcgatctttttgatcagtttgcgctcacggtcacgattacgtaactccaggctaaactcctcttcctgcgcggcgcgatcgaccggatcggggaagttggcggcttcgtcctgcatgtgcgtcacagtgcgatcgacttcatcccggagttgattacgccatgcttcaagaatacgcttgaagtgcgatagctgggcttcgttcatatactcttcgcccggtttctcctggtacggctccaccccagcgatggcgagaatactcagggacgatgttttacggttttgcccttcttgcatgttgcttctccttaacacgcactatcgatccccatgttcgggggaaaatcaggtcgctataaatagcagatgcttttccggatagcaattatctaaacgtaacacttgacaaccctgtgaggaaaagcgtatttacgcacgcggccagaatacttaataatcaggctgttattccactacaacgttatgggcactggttcgttcagttccatttttgtggctgaaagttctgctttataagctaaaacttccacgcctttattctgagcctcgctcaatagctgcgcgtattttatatcgatatgacgtgcgggggaaaaacgtgtaatggcggagtgcagcacagcgaataccaccaccgcgcgatgacctgccgccgcaacgcccatcaactcccgaagatgtttttgccctcgttcggtgatggcgtcgggaaaataaccgttttctttttccgctaacgtgaccgatttcacttcaatatagcagtccgggcggaaatctgcctgtaacataaaatctatacggctgcgctcggcgccatatttgacttcactattcagaatattgtaccccgccagcgccggcaggcgattctcctgaatcgcttctttcgttagctggttcgcccgcagcgtattcacgcaaatgaatgcgccggattgcgtttcagtcaattcccaggtatgcggatatttgcgtttagtattttctgatgtcgaataccagacggtatcgccaggcgtggcgcagccagtcatcgcgccggtattaggacagtgcagcgtaagcgtcgtaccgtcaggggtgatgacatcagctaaaaaacgtttatagcgctgaatcaacgtagcgcgttgtaaagggggtgagaatagcatcgacattccttgattattattcgcccagcgtccagcgctgcagctcggcatagcgggtacggccttgcccatacgaagaggcgtaaagcgcaaacgatgtgaccggaaatgaccagcaaaagcccggcggcgggatagccaccgtatggctggcgtcgcgcagcagcgtaatatgcgggtgaaaaggctgcgggctttggtaacaaccgctgcgggcggcctgcgcgcgcagcatattagccaactgcaacaacccgcgcggcggctggcgcattcccagccacacaacgcgcgaacgcaaccactgaccggcgtcatctagatgtagcgtaaagcccggttggcgaattcgtccggccagttgcgcaagcgcgcgctgcttatcgttactgacgtcgcctaaaaaggccagcgtcaggtgtaggttcgccgctgccacggggcgtccgtcttcagacgcaaaatgggcggcgcgccaggcgataatttgcgcgcgcgcgtcgtcgggtaagtcaatagcaaaaaacagccgttttggctcagacatagggatactcggttatggattaacacgatgctacaatgcggcgcaaagaaagttaaccccgtggagccgtttgtgacgtcattgcccgttgccgccgtattgcctgaattgttgacagccctaaaaaccgcgccgcaggttttgttgtccgcgcctaccggggcggggaaatccacctggctgccgttgcaactcctgcaacaggggccggttgctggaaaaattctcctgcttgaaccgcgtcgtctggcggcgcgtaatgtcgcccagcgtctggcggaagcgttgaatgaaaagcctggcgaaacggtaggttaccggatgcgcgcgcaaagctgcgtggggccgcgtacccggctggaagtggtgaccgaaggcgtattgaccagaatgattcagcgcgatcccgaattacgcggcgtggggctggtgatactggatgaatttcatgagcgcagtttacaggcggatttagcgttggcgctgttgctggatatccagcaagggctccgtgacgatctcaggctgttaatcatgtctgcgacgctggataacgacaggctttgtcagcgactgcctgatgcgccgacgatcgtctcggaggggcgcgcgtttcccgtggagcgacgttatcagccgcttgcggcgcatttgcgttttgatgaagccgtcgcgatggcgacagcggaactgctgcgcaatgaaaacggttcgctgctgctatttttacccggcgtaggcgaaatacagcgcgttcatgaacatctggcgtcgcgggtagggagcgatgtcctgctttgtccgctgtatggcgcattgtctctggaagcgcaacgcaaagcgattgttcccgcacccgccgggatgcgtaaagtggtattggcgactaacattgccgaaaccagtttgacgattgaagggattcgtctggtcgtcgatagcgctcaggagcgcgtggcgcgattcgacgcgcgaacgggactgacgcggctggttacgcagcgtatcagtcaggcgtcaatgacgcagcgcgcggggcgcgccggacgactggcgccgggtatctgtttacatctgctggcaaaagaacaggcggagcgggcggcggcgcaaagcgatccggaaatcttacacagcgacctctccggtttgttgatggaggtgttgcagtggggatgtcacgatccggcctcgcttttctggctggacaggccgccggaggtgaatcttcaggccgcccgccgtttattattgatgttaggcgcgctggagggcgagcgattaagcgcgcgggggcggaaaatggcggcaacaggtaacgatccgcgcctggcggcgatgttagtcaacgccgacgagggcgacagcgccgccactgccgccatgctcgcggccatccttgaggacccgccgcgaggcggcggtacggatttaagcgtgctattttcgcggcgacagccgggctggcagcagcgtagccagcagcttttaaaacggctgcaggtgcgtaatggcgagccggatagcgcgcttattatgccgctgttggccagagcgtttagcgaccgcatcgcgcggcgtcgcggtcaggaagggcgctatcagttagccaatggtatgggcgcgatgttagatgcggatgacgcgttgggacgtcatgaatggctgatcgcgccgctgttactgcaaggtagcgcctcgccggacgcccgaatattgttggcgcagccgctggatattgcctcgctgattcaggcgtgtcctgatttactgcgccagtccgacacggttgaatgggacgaggcgcagggaacgttgaaagcatggcgcagaatgcgtattggacagttgacggttagcgttcagccactggcgaagccgtctgaagaggagcttcatcaggcgatgctgaacggcatccgcgataaaggtctgtccgtccttaactggacgccggaagcggagcagttccgtctgcgtctgcactgtgcggcgaaatggctgccggaatatgactggcctgccgtggatgaggcgtcgctgctggcgactctggaaaattggttgctgccgcacatgacaggcgtacagtcgttacggagtctgaaatctctgaatgtgactcaggcgttacggggactgcttgactatgccatgctgcaacgtctggatagtgaactgcctgggcattacactgtgccgacgggaagccgaataacgattcgttatcatgaagataacccgcccgcgctggcggtcagaatgcaggaaatgttcggcgaggcaagtacgccgacacttgcgcaggggcgagtgccgctggtgctggaactgctttcgccagcgcagcgaccgctacagattacgcgcgatttaagcgctttctggcagggggcgtatcgcgaagtgcaaaaagagatgaaggggcgttaccccaaacatgtctggccggacgatccggcgaatacggctccaacgcggcgcacgaagaagtattcgtgacgtgttatacgttgcctccaggccggataaggcgttaatcgccatccggcaaaaaggtaaattgagagatttcttcttctgtcgtctggcggaagaatagagaatcgggcctttgcgcctgtatgttgcggagaaaaagcatggcggggaatgaccgcgagccgattggacgtaaggggaaaccgtcacgtcctgtgaaacaaaaggtgagccgtcgtcggcagcatgacgacgattatgatgatgactatgaggatgaagaaccgatgccgcgtaaaggtaagggcaaagggcgtaagcctcgtggcaagcgcggctggctgtggctattgctaaaactgtttatcgtttttgtggtgctgttcgccatttacggcgtctatctggatcaaaaaatccgcagccgtattgatggcaaggtctggcagcttccggcggcggtatatggccggatggtgaaccttgagccagacatgcctgtcagcaaaaacgagatggtgaaattgctggaagcgacgcagtatcgtctggtgacgaagatgacccgtcccggcgaatttaccgtgcaggccaatagcattgagatgatccgtcgtccgtttgacttcccggacagcaaagaagggcaggtgcgcgcgcggctgacgttcagtgacgggcgtctggaaaccatcgtcaatctggataacaaccgccagtttggcttcttccgcctcgatccgcggcttatcaccatgctttcttcgccaaatggcgagcagcgtttattcgtcccgcgcagcggtttcccggatctgctggtcgatacgctgttggcgacggaagaccgtcgtttctatgagcatgatggcattagtctttactctatcgggcgtgcggtgctggccaacctgacggcgggacgcacggtgcagggggccagtacgctgacccagcagctggtgaagaacctgttcctctccagcgaaagatcatactggcgtaaagcgaatgaagcctacatggcgctgatcatggatgcccgttacagtaaagatcgtattcttgagctgtacatgaacgaggtctacctcggtcaaagcggggataatgaaattcgcggttttccgctggcgagcctgtattactttggtcgtccggtagaggaactgagcctcgatcagcaggcgttactggtggggatggtaaaaggggcgtcgatttataacccgtggcgtaacccgaaactggcgctggagcgtcgtaacctagtgttacgcctgttacagcagcagaaaatcatcgatcaggaactctatgacatgctgagcgcgcgtccgcttggcgtacagccgcgcggcggcgttatttcaccgcagccagcgtttatgcagatggttcgtcaggaactgcaggcgaagctgggggataaaattaaagatctctccggcgtgaagatcttcaccacctttgactccgtggcgcaggatgccgcagaaaaagccgttgtcgaaggcattccggcgttgaagaagcagcgtaaattgagcgatctggaaactgcgatggtggtagtggatcgctttagcggcgaggtacgcgcgatggttggcggggcggagccgcagtatgctggctataaccgtgccatgcaggcacgccgttccatcgggtcgctggcgaaaccggcgacctatctgaccgcgttaagtcagccgaacttataccgtctgaacacctggattgccgatgcgccgatttctctgcgccagccgaatggtcaggtctggtcgccggagaacgacgatcgtcgctacagcgaaagcgggaaagtgatgctggtggatgcgttaactcgttcaatgaacgtaccgacggtcaatctggggatggcgttaggtttaccggcggtaaccgatacctggacgaagctcggcgtgccgaaagatcagctcaatccggttccggcgatgctgttaggggcgctgaacctgacgccgatcgaagtggcgcaagcgttccagactatcgccagcggcggaaatcgcgcgccgttatcagcgctgcgttcggttattgcggaagatggtaaagtgctgtaccaaagttatccgcaagctgaacgcgccgtaccggcacaggcggcttacctgacgctctggacaatgcagcaggtcgtccagcgtggtacggggcgtcagcttggcgcgaaatatccgggtctgcatctggtgggtaaaaccgggacgacaaacaacaatgtcgatacctggtttgccggtatcgacggcagccaggtgactatcacctgggtaggccgtgataacaaccagccaacgaaattgtacggtgccagcggcgcgatggcgatttaccagcgctatctggcgaaccagacgccgacgcctttagttctgacgccgccggaagatgtggtggatatgggcgttgattacgacggtaattttgtctgtaacggcggtatgcgcactctgccggtctggacggacgatccaaatacgctgtgccagcagggcgagatgatgcagcagcaacagcagccgtcaggcaatccgttcgatcagtcgtctcagccgcagcagcctgcgcagcaacagccgccgaaagaagagaagagcgacggcgttgccggctggattaaggagatgtttggcggcaattaatcacggtaatagtgccgggtggcgctgtgcttactcggtccacaccgttacgaccccattatgtgcgacgtaggccgaataagacgcttacatcgccatccggcaaatcctccataaataacatttcagtctaatttattaacccttccttttcatctggttgtttcttaaccccttagttttcgtagggccgcgtatcgcttgccattgcgacgatatttcgcctatcatgctgcggttataataataattatcgtttacgttatcattcactttcatcagagatataccaatggcgcgtcttaaaattgctcagccaaactcctcactgcgtaaaatcgcagttgtagtagccacagcggttagcggcatgtctgtctatgcacaggcggcggttcaaccgaaagaagaaaccattaccgtaaccgcagcgcctgcgccgcaggaaagtgcctggggaccggctccgaccatcgccgcgaagcgttccgccactaccaccaaaactgatacatctatcgaaaaaacgccacagtcggtttcggtggtcactaacgaagagatgcagatgcatcaattccagtcagtaaaagaagcgttgggttacacgccgggcgtaactgtaagcagtcgcggcgcttccaatacctatgacttcgtgattatccgtggcttctcttccgtcggcctgagccagaataactatctctggatggcctgaaattgcagggtaacttctacaacgatgcggttattgatccatccctgcttgagcgtgttgagttgatgcgtggcccaacgtccgttctctatggtaagagcaacccgggcggtatcatttcgatggttagcaagcggccgactactgagccgctgaaagaaattcaattcaaaatggggacggacaatttgttccagaccggttttgattttagtgattccctggatgacaacggtgagttctcatatcgtctgacggggctggcgcgctcgacaaatgagcagcaaaagagttctgagtcgcagcgctatgcgattgcgccctcttttacctggcgtcctgatgagaaaacgaattttacgttcctttcttatttccagaacgaaccagagactggctactacggctggctgccgaaagagggaacggttgaaccgttaccgaatggtaaacgcttgccaacagatttcaatgaaggggcgtcaaacaacacctattctcgtaacgagaaaatggtgggatacagtttcgagcatggcttcaacgacacttttaccgtgcgccagaatttacgttttgtcgaaatgaaaaccgcgcaaaaaagcgtctatggcacggggattgcggcggacggccatacgcttaaccgcggtactatcgttgacaacgagcgtttacagaatttcagcgtagatacacaactggaaagtaaattcgcgaccggcgatattgatcatacgttgctgacgggtgtcgatttcatgcgtatgcgtaatgatattaacgcgacgtttggtagcgcgccgtcaatcgatctctataacaattaccatcctgaatactttgctttcggcggcgctgagccgtaccagatgaacgaaagtaaacaaacagccttatatgttcaggatcaggcggaatggaataagtgggtatttactctcggcggccgttatgactggtctaaacaagcgataacggtgcgtcagaattccactacgccgacagaaggatatattgaacgtaatgaccaccagttcacctggcgcggtggcgtaaactacgtattcgataatggaatttcaccttacttcagctatagccaatctttcgagccaagcgccttcgatttgtggagcaccccacgtgtttcttacaagccgtcaaaaggcgagcaatatgaagcaggggtgaaatatgtaccgaaagacatgccagttgttgttacgggtgccgtttatcagctgaccaaaaccaataacctgaccgccgatccaaccaacccattagcgcaggtgccggcaggcgaaattcgtgcgcgaggtgtagagctggaagccaaagcagcattgacggctaatatcaatatgacggcgtcttacacttatactgatgctgaatacacgaaagacactaacctgaaagggaatacgccagagcaggtgcctgaacacatggcgtcgttgtggggcgattacaccttcaacgatggtccgttgtcaggtttaacgctgggaacaggcggtcgttttattggttccagttacggcgatccggccaatagcttcaaggtaggcagcgcagcggtgatggatgcggtcgtcaagtacgatctggcgcgttttggtatggcgggctccagcattgcggttaacgttaataatctgctcgaccgcgaatacgtcgccagctgcttccagacctacggctgtttctggggcgcagaacgtcaggtcgttgcaacggcaaccttccgtttctaatttctttttgggcacggcttgccgtgcccgttttacaagttggctgcgatgcaggaaaaccacattcattccgataccacctttgcgctgcgaagcgtcgcttttcgtgtgccgggccgcacgcttttacaccccctctcgttaacgtttcccgcaggtcgagtcaccggacttatcggccataatggttccggtaaatccacgctgttaaaaatgctgggccgccatcagctgccttccgaaggggatattctgctcgacaatcagccgctggcgagctggagcagcaaggcgtttgcccgcaaagttgcctatctgcctcaacaattgccgcaggcggaaggaatgacggtgcgcgaactggtggcgattggccgctatccgtggcacggcgcgttgggacgctttggcgtcgcggaccgggaaaaagtagacgaggcgattacgctggtcggcttaaaaccgctggcgcatcgtctggtcgatagcctgtccggcggtgaacgccagcgcgcgtggattgccatgctggtcgcgcaggacagccgttgtctgctgctggatgagccgacgtcagcgctggatatcgcccatcaggttgacgtgctggcgctggtgcatcgtttaagccaacagcgcgggctgacggtggttgcggtgctgcacgatatcaacatggcggcccgctactgtgattatttagtagcgctacgcggcggtgaaatgattgcgcaaggaacgcctgcggaactgatgcgcagtgacacgctggaacagatttacggtatcccgatgggtatccttccgcatccggcgggcgccgcgcctgtgagttttgtgtattaatgcgtgagttatatcctcttactcgccgccgtttattaacggcgatggcgctctcgccgctgctgtggcaaatgaatacggcgcaggctgccgctatcgatccccgccggattgtggcgctggagtggctgccggttgagctgctgctggcgctcggtattacgccttatggtgtggcggacgtgccaaattataagctgtgggttagcgaaccgccgttgccggattcggtgattgatgtgggtcttcgcactgaacccaatctcgaactgctgacggagatgaagccgtcgtttatggtgtggtcggcaggttacggaccctcgccggagaaactggcgcggatcgcgccggggcgcgggttcgattttagcgacggcaaaaagccgctggcggtggcccgacgctcgctggttgaactggcgcagacgctgaatctggaagctgcggcagaaaaacatctggcgcaatacgatcgcttcatcgccagccagaagccacgttttatccgccgcgggggacgtccgttactgatgacgacgcttatcgatccgcggcatatgctggtgctcggcccgaattgcctgttccaggaggtgctggacgagtatggcatcgtcaatgcctggcagggtgaaaccaacttttggggcagtacggcggtcagcatcgatcggctggcgatgtataaagaagcggatgtgatctgcttcgatcacgggaatagcaccgatatgaacgcgctgatggcaacgccgctgtggcaggccatgtcgtttgtccgcgccgggcgttttcaccgggtgcccgccgtttggttctatggcgcgaccctctccacgatgcattttgtccgcatcctgaataacgtgttgggaggcaaagcgtgagcagaaaacgtgaaataccggatggcggtgcgaaaaacgccttaaccgacctacggttcgggcgctttgtaggccggataaggcgaagctgccatccggcgttgctgttattggcgctgttggttgccgcctgctggctgacatgggttaacttctccgttgcgctaccgcgcagtcagtggcaacaggctatctggtcaccagatatcgacatcattgagcagatgatttttcattacagccagctgccaagactggcgatttcgctgctggtgggcgcggggcttgggctggtaggcgtcctgttccagcaagtattacgtaacccgctggcggaaccgaccacgctgggcgtggcgaccggcgcgcaattggggatcacggtgactacgctttgggcgattcccggcgcgctgaccacgcagtttgccgccctgacgggagcctgcatcgtcggcgcgctggtgttcggcgtggcgtggggcaaacgtctgtcgccagtgaccctgatcctcgccgggctggtggtcagcctctattgtggcgcaatcaaccagttactggtgattttccaccacgatcagttgcaaagcatgtttttatggagcactggaacgctaacgcaaaccgactggagcggcgtgcagcgtctgtggccgcagttgctgggcggcgtgatgctcacgttattgttgttacgtccgatgacgctgatggggctggatgacggcgttgcgcgtaatctggggctggcgctgtcgttagcgcgtctggcggcgttgtcgctggcgattgtgttgagcgcgctgctggtcaacgcggtgggcattatcggttttatcggcctgtttgcgccgctgctggcgaaaatgcttggcgcaagacgtctgctggcgcgcctgatgctggcgccgctcattggggcgcttattttatggctatccgatcagattatcctttggctaacccgcgtatggatggaagtctccaccgggtcagtgacggcgttaatcggcgcgccgctgctcctatggctgctgccgcggcttaaaagcatgagcgcgccggatatgaacgccagcgatcgtgtggcggcggagcgtcgacatgtcctcacttttgccgttgccggtggcgcgctcctgctgctggcaacatgggtcgcgctctcttttggtcgcgacgcgcacggctggacgtgggcgagcggaacgctgcttgaagaactgatgccgtggcgctggccgcggatactggcggcgttaatggcgggcgtcatgctggcggtggcgggctgcattattcagcgtctgaccggtaacccaatggccagcccggaagtgctggggatcagttccggagccgcgtttggcgtggtgttgatgctgtttttggtgccggggaatgctttcggttggctactgcctgccggaagcctgggcgcggcggcgacactgctgattattatgatagccgccgggcgcggcggtttctcgccgcaacggatgttgctggcggggatggcgctcagcaccgcgtttaccatgctgctaatgatgctccaggcgagcggcgatccgcggatggcggatgtgttgacctggatctcaggatctacctataacgccactggcgggcaggttacgcgaaccgcgatcgtgatggtgattttgctggccgttgtgccgttgtgtcgccgctggttaacgattttgccactgggcggcgatgccgcgcgcgcggtgggcatagcgcttacgccgtcgcgtatcgcgctgctggcgttggcggcttgtttgacggcaaccgcgacgatgaccattgggccgctgagtttcgttggattgatggcgccgcatattgcgcggatgctcggttttcgccggacgatgccgcatatggtcatctcagcgctggcagggggcgttttattggtctttgccgactggtgcggcaggatggcgctatttccgtatcagatcccggcgggactgctttcaagctttattggcgcgccgtactttatctatttgctacgtaaacagagccgctgagtttgccggatggcggcataaacgccttatccggcctgcggtgtagaatgtaggccgggtaagcgtaagcgtcacccggcaattcatcctttacaatttcgcaaacacccgacgcgcggcgtcaatagtattattaatgtcgtccatgctgtgtgcgaccgacataaaacccgcctcaaacgccgatggcgccagatacacgccttcctccagcatcaggtggaagaaacgcttaaagcgttccacgtcgcacgccatcacgtcctgatagcaagttacgctctcagcgtcggtgaagaaaatcccgaacatgccgccgacatggttaaccaccagcggaatattcgcttcttcggcagcttccagcaaaccttccgccaggcgggtggtgagctcatccagcgtttcatgaatgccgggctgggcgacttcattcaggcaggcgaaaccggccgccatcgcaatcgggttgccggaaagggtgcccgcctggtaaaccgggcccgtcggcgccagcgcatccattacatcgcgacgaccgccaaacgcgcctaccggcatcccgccgccgatgattttacccagacaggtcaggtccggcacgacgccgtagtaatcctgggctccggccagcgctacgcgaaaaccggtcattacttcgtcgataatcagcagcgcgccgaactcatcgcacaaggcacgcaggcccggcaggaattccggcagcggcgggacgcagttcatattgcccgccacgggttcgacgatgatacaggcgatttcctgcggatattgttcaaacgccgcgcgcactgacgtcagatcgttataagtgcaggtcagcgtatgtttcgcgaaatctgccggcacgcccggcgagttcggctgaccgagcgtcagcgcgccagaaccggctttgaccagcagacagtctgcgtggccgtggtagcagccttcgaatttgataatcttatcgcggccagtaaaaccacgcgccaggcgaatcgcgctcatcgtcgcttcggtgccggagttcaccatgcgcaccatgtccatggtcggcaccaggttggtcaccagttccgccatttttacttccatttcggttggcgcgccgaagcttaaaccgcgctccgcagcttcgatcaccgcattgcggatagccggatggttatgccccagtaccattggcccccaggaaccgacatagtcgatatatgctttgccatcgacatcgtacagatacgcgccgtccgctttttcgataaacagcggggtgccgcccacgccagtgaaggcgcgaacaggggagttcacgccgccggggatcagctcgcgggccgcgctatagagattttcagacttactcatggaaagattcctggttcgtagaaaaagtgaatacccgctattctaagttattcagagaaggttatgaaagttttacgcatttgaaacaatacgatttgcaggggattttcacggcgttggcgagtagaatgccgactttagatttgtattaccaattaatgatcttctgatgaaaacagacacttccacctttttagctcagcaaattgtgcgcttacggcgcagagatcagattcgtcggttaatgcagcgggataaaacgccgctggccatcctgttcatggcggccgttgtcggcacgcttaccggactggttggcgtcgcctttgaaaagacggtttcctgggtacaaaacatgcgcattggcgcgctggttcaggtcgcggaccatgcgtttttgctttggccgctggcctttatcctttcggcgttactggcgatggtcggctattttttggtgcgaaaatttgcgccggaagccggcggctcgggtatcccggaaattgaaggcgcgctggaggagttacgtccggtgcgctggtggcgcgtgttgccggtgaagtttatcggcgggatgggaacgttgggcgcaggaatggtattagggcgcgaagggccaacggtgcaaatcgggggcaacctggggcgcatggtgctggatgtttttcgtatgcgcagcgccgaagcgcggcatacgttgctggcgaccggcgcggcggcggggctctctgcggcgtttaacgcgccgctggcgggtatcctgtttattattgaagagatgcgcccgcagtttcgctacaacctgatttcgattaaagcggtgtttaccggcgtcatcatgtcgagcattgtgttccgcatatttaacggcgaagcgccgattattgaagtcggcaaactgtctgatgcgccggttaacacgctgtggttataccttatcctcggtattatttttggctgcgtcgggccggtatttaattcgttggtgctgcgtacccaggatatgtttcagcgctttcatggcggcgaaattaaaaaatgggtgcttatgggcggcgcgatcggcggcctgtgcggtattctggggttgattgagccggcagcggcaggcggcggatttaaccttattcctatcgccgcggcaggtaattttagcgtcgggctactgctgttcatctttattacccgggttgtcacgacgctgctttgcttttcttccggcgcgccggggggcattttcgccccgatgctggccctgggaacgctgcttggtacggccttcggtatggcggcggcagtgcttttcccgcagtatcacctggaggccggtacctttgcgattgccgggatgggggcgctgatggcggcgtcggtgcgcgccccgttgacggggattgtgctggtgctggagatgaccgataactatcagctcattttgccaatgattatcacctgtcttggcgcgacactattagcccagtttttgggcgggaaaccgttatactcaaccatcctggcgcgcactctggcgaagcaggatgcggaacaggcggcgaaaaaccagaatgcgcctgcgggcgagaatacttgaacgaattaccagggtattagataatgactgccaatattgggtgaaaatttatccaattaccgatgtcgtttggagcaaaatatgagtgatgacgtagcgctgccgctgcagtttaccgacgcagcagcgaataaagtaaaaagtcttatcgctgacgaagataacccgaatctgaaactgcgcgtgtatatcaccggcggtggttgcagcggcttccagtatggttttacctttgacgatcaggttaacgaaggggatatgaccatcgaaaaacagggcgttggcctggtggttgacccgatgagtttgcagtatctggtgggtggttcggtagattataccgaaggtctggaaggttcccgcttcattgtaaccaacccgaatgcgaaaagtacctgcgggtgtggctcttccttcagcatttgattgctgttcgttgtgccggatggcgacgcgaacatcttatccggcctacaggaaagatgttccaggcccgataagcgtagcgccatcgggcaaaacaatatcaacgtccgttttcatccagggcaaacgtcggcaatttcaaatgccagcgaatggccgccagccgaataaacagcgtgacgaccatgcccatcatgctagcgctttccagcggtactgaaaacgtataaaacgcggtggcgtgaacaatcccgccgataatacaggccgtggcatagatttcggtgcgtaggatcatggggatctcgcgtgccagaacatcgcgaataatcccgccgccgacgccggtaatcacgcccatacagacggccactaatggccccgtttcagcgaggaaggctttattcaccccaatgccgacaaacaccgccagcccgaccgcatccagtaccggcaacatccatttcggcagacgtctcggctggcgaaccagcaggatggtcagcatactggtgaccatggcgacgaccaggtcggtaggatctttaacccagaataccgggccgttatccagcgccatatcgcggattgtcccgccgccgacggcagtaacgacgccgagcaccaggacgccgaacgggtccatacgtaatttcccggccagcaacacgccagagatagcaaatacagccgtgcctacaatatccagccaatagacgagcattgtcgaatccccactaggagcctggtaagacaggctctaattcacctgtgaaagcgcattacagagttgttttgcggcgaggataatacgcgggcttgcgcgttcaaaccagtcgctgttaagcggaataaccggaatttttaacaggtttccccagtattgttcaattttgagaatttcgcccgcttttccggccacgataatggcctggggatgccttgccagcacctgctcacggctgacttgcggccacggcacgcggctgtcagcaaagacgttttctccgccgcaggtcgtcaaaacctgatgttgaatagaccctttaccactggtaaacagaggattcatgccaaactgaagaaagacgcgctttttagctttaccggcatactcgactttgagcgcggcgtactcttttagcaatgtctgcgctgcctgctgagccttttccggctgcgggctccaggcggccagttggcggagcgcgtcggcgatctgttcgatggttaccgcgtccacccacatgaccttaatacctaatgacgtcagttggtttacctggcgttccgcattaccgccgcgccaggcgacgaccagatccggcttcagcgccacaatgcgctccagattcattccctgccaggtagagacctgttctattttttgcgcttcgggcgggtagtcggaatagctgctgacgccaacgggcgtaatctcggcggcaaaagcaagctccgtattggcgggagagagcgtaattacgcgcggcgcagcgtaaagccacaccgggagcgtaagcagcagggcgcccagcgccctgaacatttgcttagccatgcgccagtttctgtaccagcgtttcgaccatcagagtcgactgtttcgccgccaccgcgaggaattcgtcaaagctgaggtgcgattgctgatcggccacgtcagagatagcgcgtaccaccacgaacggcacgttgaagttatggcagacgtgggcgatagcggtggcttccatctctacggcgaccgcgtcggggaagttatgccggattttcgccagcccgacggaaccgttaataaacgcgtcgccgctaacaataaggccgcgtaccgcgttcagattcaactccctgatgcaggattccgcggcggcgatcagcttatcatcggccttaaatccggccggacagcccggtaattgcccgtattcatagccgaaagcggtcacatcagcgtcgtggtaacgcgcttcgtcagagacgacgatatcgccgaccttcagcgtggacgccagaccgcctgcggaaccggtattgatgatcacgtccggcttgcagtgctccagaagcaacgttgcgcccagcgccgccgcgactttaccgataccggatttcagcaacgccacttcggtgccgttcaactggccagtgtaaatttcgcagccgcccagcgtaatcgtctgacggttgtcaattttgtcacgcagcagcgtaacttcttcttccattgcgccaatgatgccgattttcatagatttactcgcgataagtcagttttgggggcatagtttatcatgcgcttatggggaagcgcatttctcaggcggggagaggatatggcatcgatcgatttccgaaataaaattaactggcatcgtcgttatcgttcaccgcagggcgtaaagacggaacatgagatcctgcggatttttgaaagcgatcgcgggcggattatcaactctccggctatacgccgtttgcagcaaaaaacgcaggttttcccgctggagcgcaatgccgcggtgcgtactcgtctgacgcattcgatggaggtgcagcaggtggggcgttatatcgcgaaagagattttaagccgcctgaaagagcaaaaccgactggaggagtacggtctggatgcgctgaccggtccctttgaaagtattgtggaaatggcctgtctgatgcacgacatcggtaatccgccgttcggtcattttggcgaggcggcgatcaatgactggtttcgtcagcggctgcatccggaagatgcggaaagccagccgctcacgcatgatcgctgtgtggtttcctcgctacggttacaggaaggtgaagaaaatctgaacgatattcgccgcaaagtacgtcaggatatctgccattttgaaggtaatgcacagggaattcgtctggtacatacgctcatgcggatgaatcttacctgggcgcaggttggcggaattttaaaatatacccgtccggcatggtggcgagggccggtgccggattcccatcgctatttaatgaagaaaccgggctattatctttctgaagagaagtatattgcgaggttacgtaaagaacttcagttagcgccttacagtcgctttccattaacgtggattatggaagccgcagatgatatttcttattgtgtcgccgatcttgaagacgcggtagagaaaagaatctttagcgttgagcagctttatcaccatttatatcacgcgtggggccaccatgagaaggattcgctgtttgagctggtggtaggaaatgcgtgggaaaaatcacgcgccaatacattaagccgcagtaccgaagatcagttttttatgtatttacgggtaaatacattaaataaactggtgccctatgccgctcagcgttttattgataatttgccgcagatttttgccggtaccttcaatcaggcgttactggaagatgccagcggttttagccgcctgcttgaactctataagaatgtggcggttgaacatgtgtttagccatccggatgtagaacagcttgaactacagggataccgggtgatcagcgggttattagatatctatcagccgctattaagcttgtcgcttaacgactttcgcgagctggtggaaaaagaacggttgaaacgcttccctatagaatcgcgcttatttcagaaactttctacgcgccatcgtttggcctacgtggaagtcgtcagtaaattacccacggattcggcggagtacccggtactggaatattattatcgctgtcggttgattcaggattatatcagcgggatgactgacctttacgcatgggatgaatatcggcgtttgatggcggtcgaacagtaaatggacttttgtaaagatggacaataaatttttactttttccagaaactttattccggaacttcgcgttataaaatgaatctgacgtacacagcaattttgcgttacctgttaatcgagattgaaacacatgaaaaaaaccacattagcaatgagtgcactggctctgagtttaggtttggcattgtcgcctctgtctgccacggcggctgaaacgtcctcttcagcaatgactgcccagcagatgccaagcctggcaccgatgctcgaaaaagtgatgccatcggtggtcagtattaatgtagaaggtagcaccacggtgaatacgccgcgtatgccgcgtaatttccagcaattctttggcgatgactccccgttctgccaggacggttctccgttccagaattctccgttctgccagggcggcggtaacggcggcaacggcggtcaacaacagaaattcatggcgctgggctccggcgtaattattgacgccgcgaagggctacgtcgtcaccaacaaccacgtggttgataacgccagcgtgattaaagtacagcttagcgatgggcgtaaattcgatgctaaagtggtgggcaaagatccgcgttctgatatcgcgctgattcaaattcagaatccgaagaacctgacggcgattaagctggcggactccgacgcgctgcgcgtgggggattataccgtcgctattggtaacccgtttggtctgggcgaaacggtgacgtcaggtatcgtttcggcgctggggcgtagcggcctgaacgtagaaaattacgagaactttattcagaccgacgccgcgattaaccgcggtaactccggcggcgcgctggtgaacctgaacggtgagctgatcggtattaacaccgcgattctggcgccggacggcggcaacatcggtatcggcttcgctatccccagtaacatggtgaaaaacctgacgtcgcagatggtggaatacggccaggtgaaacgcggcgaactggggatcatggggactgagctgagctctgagctggcgaaagcgatgaaagtcgacgcccagcgtggcgcgttcgtcagccaggtgatgccgaattcgtccgcagcgaaagcgggtatcaaagccggggatgtcattacctcgctgaacggtaaaccgatcagcagctttgcggcgctgcgcgctcaggtcggcactatgccggtcggcagcaaaatcagcctcggtctgctgcgtgaaggtaaagcgattacggttaatctggaactgcagcagagcagccagagtcaggttgattccagcaccatcttcagcgggattgagggcgctgaaatgagtaataaaggccaggataaaggcgttgtggtgagcagcgtgaaagcgaactcacccgccgcgcaaattggcctcaaaaaaggcgatgtgattatcggcgctaaccagcagccggtgaaaaatatcgccgagctgcgtaagattctcgacagcaagccgtcggtgctggcgctgaatattcagcgtggtgatagttctatttatttgctgatgcagtaatcacctttgtcccccttccaccacggaagggggcaacacttttctgtgaaactccccacaactccatacttctttgcaccgttttgtgcatttgcacaatgtcgaggcctgtcatcttccttatgcttgtgctctgctcacaggagggatttatggctggctggcatcttgataccaaaatggcgcaggatatcgtggcgcgcactatgcgcatcatcgataccaatatcaacgtaatggatgcccgcgggcgtattatcggcagcggcgatcgggaacgtattggtgaattgcacgaaggcgcgttgttagtgctgtcacagggccgggttgtggatatcgacaacgccgtggcgcgacacctgcacggggtgcgtcaggggattaatcttcccttacgccttgagggcgaaattgttggcgtgatcggtctcaccggcgaaccagagcatctgcgtaaatatggcgaactggtgtgtatgactgccgaaatgatgctggaacagtcgcggttaatgcaccttttggcgcaggatagccgtttgcgtgaagagctggtgatgaacctgattcaggccgaagaaaatacgccggcgctggtggaatgggcacagcgtttagggatcgatttgaaccagccgcgtgtggcggcggtggtggaagtcgacagcggccagcttggcgtcgatagcgcaatggcggaacttcagcagttgcagaatgcgcttaccacgccggagcgtaacaacctgatagccattgtttcccttaccgagatggtggtgctcaaacccgccttaaactcgtttggtcgttgggatgctgaagatcatcgtaagcgcgtagagcagcttatctcgcgaatgaaagagaatggtcagctacgttttcgcgtggcgctgggtaattactttaccggaccgggcagtattgcacgctcataccgcacggcgcgcaccacgatgatggtcggcaaacagcggatgccagaaagccgcagctatttttatcaggatttgatgctgccggtcctgttagatagcctgcgtggcggctggcaggccaatgagctggcgcgcccgctggtaaaactcaaagcgatggataacaacgggttattacgtcggacactgacggcgtggtttcgccataatgtccagccgctggcgacctctaaggcgctgtttattcatcgtaatacgctggaatatcggctaaatcgtatttcggaactgaccgggctggatttgggaaattttgacgatcggctgttgctgtatgtggcgctacaattggatgaacagcgttaagcccggcggcgcttcgcttaccaggcctacggggatatacctgtaggccggataaggcgtaacacgtcgccatccggcaacacacagcttacttacgggtaagcttgtccagatcggcttcgatttcactgatcttattcgcgacgacgctttccagatggcgcaagtcgtcgaggatcttacgtttgagatcgagttctgagcggtcgcgctggcagatttggtccagctcgtcaatcacatagcgtaggttagggctaatctcctgtacttctttataaccctgaccgatgccatcagccaccaccgttttacgctggcgtggatacttaaacttcacgcttttagcaaagaattcacctctatccttttgaaaatagattttcaggatatcgttattggcttcttgccgcaggctgtaacgatcgatttcctcaggattggtaatgcccagactttttagattgtcatacatagcggtatccttcatcacactataacttttgaataattaacgaaaaattggtttttcgccaccaatggatacaaaaaaagcgcggttgatcgcagaagacgtctcggcaacgtcatgagcaaaagggcggcggttattgatagcttaagtaattcaacgcgatattccgtttatagagaaagcgtttgaggtcagtgtgggaaattgaccggaggcagtggtcgataaccttgagaggcggaatctatgtccggaacgtataatgccactattcgccgggtggtgatttccgcctggataggaaactccattgaatattatgattttctattatacggcttagcaagcgcgctggtatttggcccgctttttttcccctggcgccagcccattgactgcaacgttatcttcttttgccagtttcggcgtgggatttatttcccgaccgctgggcgcgctattttttggcaacaggggggatacgcttgggcgtaaaaacacgttattaatcacgttaggcgggatgggcgcggtcacgtttctcatcggttgcctgccttcttacgccagtatcggcgcgctgacacctgctttactggttattctacgttttctacagggatttatggttggaggtgaatggggaggcgccatgttgatggtcgtggaatatgctgctggaaagcaccgggggcggttaagcgcgctatcgcaaacaggaggactcacgggacaattattggcgacaggcgtatttatagtcgtgacccaattaccgcaggaggcgttgttatcgtggggatggcgtattccttttctgctcagtgcgcttttggtgttgccgggattatatatgcgtcatcgtctggatgagacgcctgtcttccgtgcgtttaaaaagcagcaggccattaatcataggcagcaaagggatgaaaggccggtggtcaaagtagtacgagaacaatggcgtagcattttgctgattataattctgcgttttgcggaaagcgttcccttttttcttgctaccgtcttcgcggtttcctgggcgacgacgcagcttgggattgccagcctgactattctgtacattgtaatgttcacctgtctgctggcgtatcccatgcacgtgctatttggcatcatgtcggatcggcgtggctgccgtcaggtgtatattttcggcgcgctttttgtcgcggcaatggcttttccctttttctggctgctggaaagccgttcgctcatactgatgacaatgggctacgttctgcttattaacattggtcataattcactgaatgccgtgcaaccttcttttttcgccggactgtttcatccgcctgtacgctacagcggttcatcaattggcgctcagttgggggcggttgtggcagggggattcacgccgtttatcgctaaagcgttaagcgcagtctatgataacagttggactttggttgccggttatgtcgttttgactgcgctggcttcggcgtttgcggcaaagattgcgccggacaccgtgttaccgcattcgccgtaatgcaaaggggggctgtcgcccccgcttttcactcgcttaatcaatcgtgcgcaataattcgttaatgcccactttaccacgcgttttggcgtcgacttttttcacgatcaccgcgcagtacaaactgtacttaccgtcttttgacggcaggttgccggaaacgaccacggagcccgccggtacgcggccatagtgaacttcaccggtttcgcgatcgtagattttggtgctctggccgaggtatacgcccatggaaatgacggaaccttcttcgacaatgacgccttccacgacttcagaacgcgcgccaataaagcagttgtcttcaatgatggtcgggttagcctgcagcggctccagtacgccgccgatacccacgccgccggaaaggtgaacatttttaccaatctgcgcacaggaacccaccgtcgcccaggtgtcaaccatggtgccttcgtcaacgtaggcgccgatgttaacgtaagacggcatcagcacggtgttgcgggcgataaatgcgccctgacgaacggccgcaggcggaacgacgcggaagccttctttctgaaaacgcgcttcgtcgtaatcagcgaatttcatcggggctttatcgaagtagcggctttccgcaccgtcgataacctggttatcgttaatacggaaagagagcagaaccgctttcttcaaccactggtgagtgacccactgaccgtcgattttttctgcgacacgcagcgcgccggaatcaagtagagaaatgacctgttttaccgcctctcgggtcacggtatctacattagccggcgtaatatcggcgcggcgctcaaaagcggtctcaataacgttctgtaactgctgcattgttaaactctttcatataaataaacacactaccctttatcgtttggattgagggccgctgtcaaccgttgttgcacctcaagttgcagcacattattaagtgcgcgccgatccgctgtggcgattatgaataaatcttctactcgttcaccaatggttgtaattcgggcaccatgaagcgaaattcccagatcggcaaaaatttgtccgaccctggccagcagaccaggttgatcgagcgcgatcaattccatgaatgattttctgtcggtatgggtgggcagaaaattgacttccgtttcgaccgtaaagtgccgtaactttgccggttgccgacgcggctgcggcggctgccagctatgctgcgtaatggtctgttcaagaccggtgcgaataacgtcatggcgatctgccgccagcgggctgccgtctggttccagaacgataaacgtatccattgccatgccgtcgcgagtggtaaagatctgcgcgtcatggacgcttaaattacgcctgtccagctcggcgcagacggcggcaaacagatagggtctgtccggactccagataaaaatttcggttccgccgcgcgtggcttgcggactgagcaacactaacggttggctcagatcgtgctgcaataaatggcgtgcgtgccaggcgagctgatttggactatgacgaacaaaatagttagcgcgacagcgggtccagattttgtgcagcgcggcttcatcaatattgtccattcgcagcagcgccagcgcctgaagctgatggtgacgcacgcgctcacgcatatccggcgtattttgcattccacgcctgagctgtttttcagtggcgaagtacagctcgcgcagcaggctctgtttccagctattccacaaggtttcgttggtcgcgcagatgtccgcgacggtcaggcagaccagaaaacgcagccgtgtttcggtttgcacctcttcggcaaactgcttgatgacttccggatcctggatgtcgcggcgctgagcggtgactgacattagcaggtgttggcgcaccagccaggcgaccagttgcgtttcgcgtgagttcaaaccgtgcagttcggcgaaggtgagtacatcctgcgcgcccagtaccgaatggtcgccgccgcgtcctttcgcaatatcgtggaacagcgcggcgatcaggatcagttccggatggggaagccgcggccagagatcgacgcatagcggatggcgctggcgtgtctcttctttcgcaaagctctccagtttgagcattacgcggatggtgtgttcatccaccgtgtatgcgtggaacaggtcaaactgcatttgtccgacgatgtgcgaccactgcggcatataagcccacagtacgctgtggcgatgcatgggcagcaggccgcggctgaccgcgccgggatggcgtagcatactcagaaacagagtgcgcgcctccgggatgtaacacagcggttggctcaggtggcggcgggcgtggcgcaagtggcgtaacgtcgtagagtagatgccggtgatcgcgctattgcgcaccatcatataaaacatccgcaggatcgcttgcggttcgcggataaacagcgtgtcgtcacgcagatcaatgagcgtgccgcgcagttgaaactcatcgtcaacaggacgtggtttttcatccgcaggcagcgccagaatcgcctcgtcaaatagctgaagcagcatctgattaagttcgctcacccgacgcgtaacccggaagtagtctttcatcatccgctcaaccggatcattgccctcgccgctgtagttaaggcgttgagcgacgcttaactggcggtcgaacagcaggcggttatcgtagcggctgaccaccagatgtagcgcaaagcgaatgcgccacaggatatgcaggcactcgttgagctccgcgcactcagccggggttaaaaagccgaatcccaccatctcatcgagcgaggtggcgccgaagtgacgtcgggcgacccactgcaatgtatggatatcgcgcaggccgccggggctgcttttaatatccggctccagattatagctggtaccgtgatagcgctggtggcgctggttctgctcttctactttggcggcgtaaaatttgtcggacggccaaaaaccttcgctgaaaatatgtttttgtagtgccagaaacagagcgacatcaccgatcagcaggcgcgtttcgatgaggtttgttgcaacggttaaatcagacagaccttccagcagacactcttccagcgtacgtacgctatgcccgacatccagcttgacgtcccaaagtaaagtcagcagctcgccgaccttttgcgcctgttcatcgggcagctttttgcggcttaaaatgagcagatcaatatcggaaagcggatgcagttcgccgcgtccatagccgccgacggcgaccagcgccagatcggcaatctgaccgaaaccggcctcaatccacaggcgttgcaacaactggtcgataaattcggttcgggcttcaataagctgttcagcacaaatgccgctgtcaaatgcctctcccagccagtgttgaaagatgtcgatgcgggctttgataccggcgacggtcagttcagcgcgcggccagacgccagggttttgcggctggtcagggagggtggggagtgcggtattcgcgtgctgttcaggaagagtattcatatgcgccacccattaaaaagccggatggtggcgtgaacgccttatccggcctacgaagtagtacaatttgtaggcctgataagatgcgaaggcatcgccatcaggcaaaacattattcgtcgtgtgtgatgatcgccgggatggtgtcatctttacgcagcgtcagaatttcacagccgttttccgttaccacaatagtatgctcgtactgagcagacaagctgcggtctttggtttttaccgtccagccgtctttcatggtgcggatacggtaatccccggcattcagcatcggttcaatggtaaaggtcatgccaggctgcaacacgacgccaccatcgtctgcatcataatgcagcacctgcggttcttcatggaagccgcgaccaataccgtgtccgcagtattcacgtaccacggagaaaccttcgccttcggcatatttctggatggcggcgccaatggtgcgcaggcggatgcccggtttcaccattttgatgcccagatacaggctctcttgcgtgacgcggcacagacgctcgcccagaatagtcggtttgccgacgataaacatctttgaggtatcgccgtggaattcatctttaatcacggtcacgtcgatgttgacgatatcaccatctttcagatgtttagcgtcatccggaatgccgtggcacaccacttcattaatagagatacagacggatttcggatagccgtggtagccgaggcaggcggagatcgcgtgttgttcgttaacgatgtaatcgttacagatacggtccagttcgccggtggtgacgcccggtttgatatacggttcgatcatttccagcacttcggctgccagacggcccgcgacgcgcattttttcgatgtcttcagatgtcttgatagagatagccatgaattctgtccatcagtgccgatgatttcggcaataattgtgtaagtgctgacaatggtatcagtcaggggtgtaccctgccaaattgagaatcattctgaacttcgcctttcgtgccacaggtgcgttggcgacattttttcaccccagtcacttactggccgtaagctcccggggatgcaaaaatttgccgcctgcctgtaacacgaaattcatcgttcaattcagcactgagtgccaacaattattggtgtcggtggcgtatttgtggtataaagcgtgccggacttccgatccattcgaagactacacacgatggacgggagcgacaaatctcactttgtgtaacaacacacacgtatcggcacatattccggggtgccctttggggtcggtaatatgggatacgtggaggcataaccccaacttatctatagaggttttaaatcatggcaactgtttccatgcgcgacatgctcaaggctggtgttcactttggtcaccagacccgttactggaacccgaaaatgaagcctttcatcttcggcgcgcgtaacaaagttcacatcatcaaccttgagaaaactgtaccgatgttcaacgaagctctggctgaactgaacaagatctctgctcgtaaaggtaaaatccttttcgttggtactaaacgcgctgcaagcgaagcggtgaaagaagctgctaacagctgcgaccagttcttcgtgaaccatcgctggctgggcggtatgctgactaactggaaaacagttcgtcagtccatcaaacgtctgaaagacctggaaactcagtctcaggacggtactttcgaaaagctgaccaagaaagaagcgctgatgcgtactcgtgagcttgagaaactggaaaacagcctgggcggtatcaaagacatgggcggtctgccggacgctctgttcgttatcgatgctgaccacgagcacattgctatcaaagaagcgaacaacctgggtatcccggtatttgctatcgttgataccaactctgatccggacggcgttgacttcgttatcccgggtaacgatgacgcaatccgtgctgttagcctgtacctgggcgctgtcgctgcaaccgttcgtgaaggccgttctcaggatctggcttcccaggcggaagaaagcttcgtagaagccgagtaataaggcttgataactccctaaaatagttcgagttgcaggaaggcggcaagctcgagaattcccgggcgcttacatcagtaagtgtccgggatgagcgagtgaaggcaacgcgcctgcggctcgaaatatgaaggggagagcccttatagaccaggtagtatcacgtttggttagggggcctgtatatggccccctttttcacttttatatctgtgcggtttgatgccgggcagatcaaatctttcgaggattttagaatggctgaaattaccgcatccctggtaaaagagctgcgtgagcgtaccggcgcaggcatgatggattgcaaaaaagcgctgactgaagcgaatggcgacattgagctggcaatcgaaaacatgcgtaagtccggcgctatcaaagcggcgaaaaaagcaggcaacgtggctgctgacggcgtaatcaaaaccaaaatcgacggtaacgtcgctttcattctggaagttaactgccagactgacttcgtggctaaagatgctggcttccaagcatttgctgacaaagtgctggacgccgctgttgctggcaaaatcactgacgtagaagtcctgaaagcgcagttcgaagaagagcgcgttgctctggttgcgaaaatcggcgagaacatcaacattcgtcgcgtcgcttccctggaaggcgacgtgctgggttcttaccagcacggtgcgcgcatcggcgttctggttgccgctaaaggcgctgacgaagagctggttaagcagctggcgatgcacgttgcggcaagcaagccggaattcgttaagccggaagacgtgtctgctgacgtggtagagaaagagtaccaggtacagctggacatcgcgatgcagtccggtaagccgaaagaaatcgcagagaaaatggttgaaggccgcatgaagaaattcaccggcgaagtttctctgactggtcagcctttcgtcatggaaccgagcaaatctgttggccaactgctgaaagagcacaacgctgacgtgactggcttcatccgctttgaagtgggcgaaggcattgagaaagtcgagactgactttgcagcagaagttgctgcgatgtctaagcagtcctgattttcctgaggagccgcctgagggcggcttctttttgcgcctctcttgtaaaatcagccgacgcctggcgtctgcgctgaaatgcgacgtacaatgtcgccggaattaactcatatcaatcgttgacagtctcaggaaagaaacatggctaccaatgcaaaacccgtctataaacgcattctgcttaaattaagcggcgaagctctgcagggtacggaaggcttcggtattgatgcaagcatactggatcgtatggctcaggaaatcaaagaactggttgaactgggtattcaggttggtgtggtgattggcggtggtaacctgttccgtggcgcgggtctggcaaaagcggggatgaaccgcgttgtgggcgaccacatgggcatgttggccaccgtcatgaacggcctggcaatgcgtgatgcgcttcaccgcgcctatgtgaacgcccgcctgatgtcggcaattcctttaaacggcgtgtgcgacaactacagttgggccgaggctattagcctgctgcgtaataaccgtgttgtgattctgtctgcaggtacgggtaacccgttcttcactaccgactctgcggcctgtctgcgcgggatcgaaattgaagcggatgtcgtactgaaagcgaccaaagtggatggtgtattcactgccgatccggcaaaagatccttccgcgaccatgtacgatcagctgacctacagcgaagtgctggataaagagctgaaagtgatggatctggcggcgttcacgctggctcgtgaccacaaactgccgattcgtgttttcaacatgaacaaaccgggcgcgctgcgtcgtgtggtgatgggcgaaaaagaagggacgttaatcacggaataattcccgtgagcgccaaatacgggtaagattctgttctattgacgggtcttattacctggcagaaattaaacgagactatacttagcacatctttatattgtgtgaccgtctggtctgactgagactagttttcaaggattcgtaacgtgattagcgatatcagaaaagatgctgaagtacgcatggaaaaatgcgttgaagcgttcaaaacccaaatcagcaaagtgcgcacgggtcgtgcttctcccagcctgctggatggtattgtcgtagaatactatggcactccgaccccgctgcgccagttggcaagcgtaacggtagaagactcccgtaccttaaaaattaacgtgtttgaccgttctatggggccagccgttgaaaaagcgatcatggcgtcagacctcggtttgaatccaagctctgcgggcaccgatattcgcgttccgctgccgccgctgaccgaagaacgtcgtaaagatctgacgaaaattgtccgtggagaagcggagcaggcgcgtgtcgccgtacgtaacgtccgccgtgatgcgaacgataaagtaaaagctctgctgaaagataaagcgatcagtgaagatgacgatcgtcgctctcaggaagaagtacagaaaatgaccgacgcggcaattaagaaagtggatgcggcgttggcagataaagaagcagaactgatgcagttctgattgatctgtacgcagatataaactcattccaccgctaaacctggcggatgagtggtgtacaaagcgccgcgcagaagacattatcaggtctcctgtgcggcgttttgctttttattccgtttcaacacttctggacgtttcatgaagcaattaaccattctgggctcgaccggctctattggttgcagcacactggacgtggtgcaccataatcctgatagctttcgcgttatcgcgctggtggcgggtaaaaatgtcgcccgcatggcggagcagtgcctggagttctcgccgcgttatgccgtgatggacgatacgtcgagcgcagaacagctcaaaataatgcttcagcagcatggcagccgcaccgaggttctgagcggtcagcaggctgcctgtgagatggcggcgcttgatgaggttgggcatgtgatggcggccattgtgggcgcggctggtttactgccgaccttggcggcgatccgcgcagggaagacgattctgctggcgaataaagaatcgctggtgacctgcgggcggctgtttatggacgaagtgaaacgcagcaacgcccggcttttacccgtcgatagcgaacataacgcgatttttcagagtttgccgcaatctattcagcataatctgggatacgctgaccttgagcaaaatggcgtaacgtcgattttgcttaccgggtctggtggcccgtttcgtgaaacgcccatgtgcgatctggcagcgatgacgccggatcaggcatgtcgtcatccgaactggtcgatggggcgaaaaatctccgtcgactccgccaccatgatgaataaaggtctggaatacattgaagcgcgttggttatttaatgccagcgcacgtcagatggaagtgttgatccatccgcaatcggtcattcattcgatggtgcgttatcaggacggcagcgtcctggcgcagcttggagaacctgacatgcgtacgcctattgcgcatacgatggcatggccgaatcgcgtcacgtccggcgcgcagccgctcgatttttgcaaactcagcgcgctgacgtttagcgcgccagattatcagcgttatccttgcctgaagctggcgatggaggcgtttgagcaaggtcaggcggcaacgacggcgctcaatgcggcaaacgaaatcaccgttgccgcgtttctggcgcaacagattcgttttaccgatatcgccgggctcaatttagcggtgctggagaggatggatttacacgaaccggcaagcgttgatgacgtattgcaggttgacgccatcgcgcgtgaagtagccagaaaacaagtgatacggctctcacgctgacgattatcccgcgacagaagatcgtgctatttgttagcgttgggcttcggtgatatagtctgcgccacctgatcgcaggtttttggcttttttcggtcaggttagccgtggttttacacggcttttttgtggatacacaaaatcattcaggacgcatcgggacggcaggcggatacgttcccggcgtgcgcagacagcgcacgacaggggcgatgacgcgcagtcattcgcgaagcgaaccgaagagaatgtgtataaaggcttcagtattcctgagtaccgctaaatcctttcagggacaaaaaacgcgttatgttgtctgcaactcaaccagtaagcgaaaatttgccagcacatggctgccgtcatgttgccataattatggatggcaatggccgctgggcgaaaaagcaagggaagatccgggcctttgggcataaagccggggcgaagtccgtccggcgagcggtctcttttgctgccaataacggtattgatgcgttaacgctgtatgcctttagtagtgaaaactggaaccgaccagcgcaggaagtgagcgcgttaatggagctgtttgtgtgggcgctggatagcgaagtcaaaagcctgcaccgccataacgttcgcctgcgtattatcggcgatatcagccgatttaactcacgtttacaagaacgtattcgcaaatcagaagcgcttaccgcccataatacggggctaacgttgaatatcgctgcgaattacggcggacgttgggatattgtccagggagtccgacaactggcggagctggtgcaggctggagtgctgcgccccgatcagattgatgaagagagactaggccagcaaatctgtatgcatgagctggcgcctgtggatttagtaattaggactgggggagagcatcgcattagtaactttttgctttggcaaattgcctatgccgaactttactttacggatgttctctggcccgatttcgatgaacaagactttgaaggtgcgctgcatgcctttgctaatcgagagcgtcgtttcggcggtaccgagcctggtgatgacaaagcctgatgggggtcgcttttgctgaagtatcgcctgatttctgcttttgtgttaatacccgcggtcatcgctgcgctttttttattgccgccggtggggttcgccattattacgctggttgtctgtatgctggccgcgtgggaatgggggcagttaagcggtttcgccgcgcgttcacagcgggtttggctggcggtgctgtgtggtctgttattggcgctgatgttatttttgttgcctgagtatcatcacaacattcgtcaaccgctggttgagatgtcgctttgggcatcgttaggatggtgggttgtcgcgctactgctggtgctattttatcccggttcggcggcaatctggcgcaactcaaaaacattgcgtctcattttcggtttgttaactattgtgccatttttctggggcatgctggcgctgcgcgcctggcactatgacgagaatcattacagtggcgcaatatggttactctatgtcatgatcctggtctggggagcggactctggcgcgtatatgtttggtaaattgtttggcaaacataagctggcgccgaaggtttccccgggtaaaacctggcaagggtttatcggcgggcttgctacggctgccgtgatctcatggggttacggtatgtgggcgaatctgaatgttgcgcctgttatcttgctgatttgctctgtggtggcggctctggcttctgtactgggcgacctcaccgagagtatgtttaagcgcgaagcaggaattaaggatagcggccacttgatcccaggccatggcggcattctggaccgaattgacagtctgacggctgccgtaccggtctttgcttgcctgttgttactggtgttcaggacgctctaacggaaggttttatgctgagtattctctggaatctggctgcattcatcatcgcactgggcgtgctgatcactgtgcatgaatttggtcatttctgggttgcccggcgctgcggtgtgcgagttgagcgcttttccatcggttttggcaaagcgctctggcgtcgtaccgatcggtacggcaccgagtatgtcatcgccctgatcccgctgggcggctacgtcaaaatgctggatgagcgcgccgaaccggtagcgccggaattgcgtcgtcacgccttcaataacaaaacggtgggccagcgcgccgcaattattgccgcaggtccggttgcgaacttcatttttgctatctttgcttactggctggtctttatcatcggcgtccctggcgttcgtccggtcattggcgaaataacgcccaactcgattgctgcgcaggcgcaaattgcgcctggtacggaacttaaagccgttgatggtatcgaaacccctgattgggatgccgtgcgtttacaactggtgtccaaaattggcgatcagcagacgacggtgagcgtcgcgccgtttggcagcgaccagcggcaggacaaaacgcttgatttacgtcactgggcatttgagcctgataagcaagatcctgtatcttctttagggattcggccccgcgggccacagattgaaccggtactgtcagaagtgcaggcgaattccgcagccagtaaagcgggtttgcaagcaggcgacaggatcgttaaagtcgatggtcagccgttaacgcagtggatgaaattcgtgacgtttgtacgtgataatcccggtaagccgttagcgttagagattgaaaggcaggggagcgccttgtcgttgacgttaacgccggatacgaaatcggttaacggaaaggcggaagggtttgcaggcgtggtgcctaaaattattcctctgccggaagagtacaagactatacgccagtatgggccttttagcgccatcctcgaagccacggataagacgtggcagttgatgaagctgacggtcaatatgctgggtaaattgataaccggtgatgtgaaactgaacaacctcagtgggccgatttctatcgctcagggggctgggatgtcagcggagttcggggtgatttattacctgatgttccttgcgctaatcagcgtgaacttagggataattaacctgtttccgctgcccgttcttgacgggggtcatctgctgttcctggcgattgaaaagcttaagggcgggccggtatccgagcgggttcaagactttagttatcgcattggctcgattttgctggtgttgttaatggggcttgcacttttcaatgatttctctcggttgtaagagagttagttaggaagaacgcataataacgatggcgatgaaaaagttgctcatagcgtcgctgctgttcagcagcgccaccgtatacggtgctgaagggttcgtagtgaaggacattcatttcgaaggcctgcagcgagtcgccgttggtgcggctctcctcagtatgccggtgcgcacaggcgacacggttaatgatgaagatatcagtaacaccattcgcgctctgttcgccaccggcaactttgaggacgtccgcgtcctgcgcgatggtaatacccttctggttcaggtaaaagaacgtccgaccattgccagcatcactttctccgggaacaagtcggtgaaagatgacatgctcaagcaaaacctcgaagcgtctggcgtacgtgttggcgagtctctggatcgcaccacgctgtctgatatcgaaaaaggtctggaagacttttactatagcgtaggtaaatacagcgccagcgttaaggcggtcgtcacgccgctaccgcgcaaccgtgttgatcttaaactggtgttccaggagggcgtatcggcgaagatccaacagatcaacatcgtcggtaaccatgcctttagcaccgaagaactcatttctcatttccagttgcgtgacgaagtgccgtggtggaacgtcgtcggcgatcgtaaataccagaaacagaagctggcgggcgaccttgaaaccttgcgcagctactatctggatcgcggctacgcgcgtttcaatattgactccacgcaagtgagtctgacgccggataagaaagggatctacatcaccgtcaatatcaccgaaggcgatcagtacaagctttccggggttcaggtgagcggtaacctggccggacattccgctgaaattgagaaactgacgaaaattgaaccgggcgagctctataacggcaccaaagtgaccaaaatggaagatgacatcaaaaagcttctgggtcgctatggttacgcctatccgcgcgtgcagtcacagcctgaaattaacgatgctgacaaaaccgtaaaactgcgcgtgaacgtcgatgcgggcaaccgtttctacgtgcgtaagatccgctttgaaggcaacgatacctcaaaagattccgttctgcgccgtgaaatgcgccagatggaaggggcgtggctgggcagcgacctggttgaccaggggaaagagcgtctgaaccgtctcggcttctttgaaaccgtcgacaccgacacgcagcgcgttccggggagcccggatcaggttgatgtggtgtacaaggtgaaagagcgtaacaccggtagcttcaacttcggtatcggttacggtacagaaagcggcgtgagcttccaggccggcgttcagcaggacaactggttaggtaccggttattccgtggggattaacggtaccaaaaatgactaccagacctacagcgaactgtccgttactaacccatactttaccgttgacggcgtgagcctcggtggtcgtatcttctataacgactttgaagcggatgatgccgacctgtccgactataccaacaagagttacggtacggatgtgacgcttggcttccccatcaacgagtacaacacgttgcgtgctggtctgggctatgtccataacaaactgtccaacatgcagccgcagatcgcgatggatcgttatcttgaatcgatgggcgaccctgatgccagcgattttgccgctgacgacttcacctttaactacggctggacctataacaagcttgaccgtggttatttcccgacggacggctcgcgagtcaacctgacgggtaaggtgacgattccaggttccgacaacgaatactacaaagtgtcgctggataccgcgacctatgtgcctattgataacgaccacaagtgggtggttctggggcgtactcgttggggttacggcgatggtttaggcggcaaggaaatgccgttctatgagaacttctatgccggtggttccagtaccgtgcgtggtttccagtcgaatactatcggcccgaaagcggtctataaaaatggcgcccacactagttgggacgatgatgatgattacgaagactgtactcaggaatcaggctgtaaatcagatgatgcggtaggtggtaatgccatggctgtcgccagcctggaatttattaccccgacgccgttcatcagcgaaaagtatgccaactcggttcgtacctccttcttctgggatatgggtaccgtttgggatacgaactgggatccgtcatctgcgccgtcagatgtaccggattacagcgatccaggcaacatccgtatgtccgcgggtatcgcattacaatggatgtccccattggggccgttggtcttctcctacgcccagccgtttaaaaagtacgatggagacaaagccgagcagttccagtttaacattggtaaaacctggtaattgttcactgcaaaggaatgcattggtagtgtagcgatgacttttggcgatgcccccagggatcgccaggccacgcaaagagctgtaccttcgggtgcaaatgggatggtaaggagtttattgtgaaaaagtggttattagctgcaggtcttggtttggcgatggttacgtccgcacaggctgctgacaaaattgcaatcgtcaacatgggtaatctgttccaacaggttgcgcagaagacgggtgtatccaatacactggaaaacgaatttaaaggccgtgcggctgaactgcaaaaaatggaaaccgatctgcaatctaaaatgcagcgtctgcaatccatgaaagcaggtagcgatcgtactaagctggaaaaagacgtgatgtctcagcgccagactttcgcacaaaaagcgcaggcttttgagaaagatcgcgctcgtcgttccaacgaagaacgcaacaaactggtgactcgtatccagactgcggtgaaaaaagtggctaacgaccagagtatcgatctggtggtagacgcaaacaccgttgcttacaacagcagcgatgtgaaagacatcaccgctgacgtactgaaacaggttaaataagtaatgccttcaattcgactggctgacttagcagaacagttggatgcagaattacacggtgatggcgatatcgtcatcaccggcgttgcgtccatgcaatctgcaacaacaggccacattacgtttatggtaaatcctaagtaccgtgaacacttaggtttatgccaggcttctgcggttgtcatgacgcaggacgatcttccttttgccaagagcgcggcgctggtagttaaaaatccctacctgacctacgcgcgcatggcgcaaattttagatactacgccgcaacccgcgcagaatatcgcgccaagcgccgtgattgatgcgacggcaacgctgggtagcaatgtttcagtcggcgcgaatgcggtgattgaatctggcgtacaactgggcgataacgtggttatcggcgcaggctgtttcgtcggaaaaaatagcaaaatcggggcgggttcacgcttgtgggcgaacgtaacgatttaccacgacattcagatcggtgagaattgcctgatccagtccagtacggtgatcggcgcggacggttttggctacgctaacgatcgtggcaactgggtgaagatcccacaactgggccgggtcattattggcgatcgtgtcgagatcggcgcttgtaccaccattgaccgtggcgcgttggatgatactgttattggcaatggcgtgattattgataatcagtgccagattgcacataacgtcgtgattggcgacaatacggcagttgccggtggcgtcattatggcgggtagcctgaagattggccgttactgcatgattggcggcgccagcgtgatcaatgggcatatggaaatatgcgacaaagtcacggtaactggcatgggtatggtgatgcgtcccatcacggaaccgggcgtctactcctcaggcattccgctgcaacccaacaaagtatggcgtaaaactgctgcactggtgatgaacattgatgatatgagcaagcgtctcaaagcgattgagcgcaaggttaatcaacaagactaacgttccgccttgtagttgccattcttttccggcctgtcacattcatacgattgcggcaggccgtgttattattgcctttttgtatatttggacaggaagagtattttgactactaacactcatactctgcagattgaagagattttagagcttctgccgcaccgttttccgtttttactggtcgatcgcgtgctggactttgaagaaggtcgttttctgcgtgcggtgaaaaatgtctccgtcaacgagccgtttttccaggggcatttcccgggcaaaccgattttgccaggcgtgctgattctggaagcgatggcgcaggcaaccggtattctggcgtttaaaagcgttggtaaactggaacctggcgaactgtattatttcgcgggtattgatgaagcgcgctttaagcgtccggtggtgccaggcgatcagatgatcatggaagtcactttcgagaaaacgcgccgtggcctgacccgctttaaaggggttgcgctggtcgacggtaaagttgtgtgcgaagcaaccatgatgtgtgctcgtagccgggaggcctgattcgtgattgataaatccgtctttattcatcctaccgccattgtggaagacggcgctgtaattggcgctaatgcccacattggtcccttttgtattgttgggccgcaggtcgaaattggtgagggaaccgtactgaagtctcatgtggtcgtaaatggtcaaaccaaaatcggccgcgacaacgagatttatcagtttgcctccatcggtgaagtgaaccaggatctgaaatatgcgggtgagccaacccgtgtggaaattggcgatcgtaaccgcatccgcgaaagcgtcaccattcatcgtggtacagtgcagggcggtgggttgacgaaggtgggtagcgataacctgctgatgatcaatgcgcatgtcgcacatgattgtacggtaggtaatcgctgtatcctcgccaacaacgccacgctggcggggcacgtatcagtcgatgattttgcgatcatcggcggtatgacggcagttcatcaattctgcattatcggtgcgcatgtgatggtcggcggctgctccggcgtggcgcaggatgtccctccgtatgtgattgcgcagggtaaccatgcgacgccgttcggggtaaatatcgaagggctgaagcgtcgcggctttagccgtgaagggctggtggcgattcgtaatgcctacaaactgttgtaccgcagtggtaaaacgctcgacgaagcgaagctggaaatcgctgaacttgctgaaaagcatccggaagtgaaggcgtttaccgagttctttgagcgttcaacgcgcggtccgattcgttaatggcggcacagcgtcctttaacgattgccctggtcgccggtgaaacgtccggcgatattcttggcgcaggcttaattcgtgcgctgaaagcgcgcgtacccaacgcccgttttgtgggcgttgcggggccgcgtatgcaggccgaagggtgtgaagcctggtacgagatggaagagctggcggtcatgggcattgttgaagtgctcggacgtttacgccgtttgttgcatatccgcgccgatctgacccgccgttttaccgaactcaagcccgatgtctttgtcgggattgatgcccctgatttcaatattaccctcgaaggtaatctgaaaaaacaagggattaagaccattcattatgtcagcccgtccgtttgggcctggcgacagaaacgcgttttcaaaataggcagatccacccatatggtgttggcttttctgcctttcgaaaaagcgttttacgataaatttaacgtcccgtgccgctttatcggtcacaccatggcggatgccatgccgctggacccggataaaaatgcggcgcgcgacgtgctgggtatcccgcatgacgcccattgtctggcgctactgccaggcagccgtggcgcggaagtggaaatgctcagcgccgacttcctgaaaaccgcacaattgctgcgacagcgctatcccgatctggaagtggtagtgccgctggtgaacgcgaaacgccgcgagcagtttgaaaaaattaaagcggaggttgcgccggatctcgccgttcatttgctggacggcatggcgcgcgaggcgatgatcgccagcgacgcggcgttgctggcctcaggcacggcggcactggagtgtatgctggcaaaatgcccgatggtagtggggtatcgtatgaagcccttcactttctggctggcgaaacgtctggtgaaaacggagtatgtgtctttgcctaacctgctggcgggaagagaattagtcaaagagctgttgcaggaagagtgcgaaccgcaaaaactcgccgaagcgctgttgccgctactggcgaacggtaaaaccagccatgcgatgcacgacaccttccgtgaattgcatcagcagatccgctgtaatgccgatgagcaggcggcagatgccgtcctggagttagcacaatgatcgaatttgtttatccacacacccatttagtggcgggtgtggatgaagtgggccgtggcccgctggtgggcgccgtagtgaccgccgccgtgatcctcgatccggcgcgtccgatcgtcggtctgaatgattccaaaaaattgtctgaaaagcgtcgtctgtcattgtatgacgagattaaagaaaaggcgttaagctggagtctgggacgcgcggaagcgcatgaaattgatgagctgaatattttgcacgccaccatgctcgccatgcagcgcgctgtcgctggtctgcatattgcgccagaatatgtgctgatcgacggcaatcgctgtccggagctgcctgtgccgtcaatggccgtggtgaaaggcgacagccgcgtggcggagattagcgcggcgtctattctggcgaaagtcacccgcgacgcagaaatggcggcgctggatatcgtttttcctcagtatggctttgcgcagcacaaaggctatccaaccgcttttcatctggaaaagttggcccagtatggcgcgacggcgcaccaccgacgcagttttgcgcctgttaaacgcgctctgggacttgtgtcctgattcttgtatcgagaaatctgaagatgtctgaaccacgtttcgttcacctgcgggtgcacagcgactactctatgatcgatgggctggcgaagaccgggccgctggtgaaaaaggcggcctcattaggtatgcctgcgctggcgatcaccgattttaccaacctctgcggtctggtgaagttctacggagcgggtcatggcgcgggcattaaacccatcgtcggggcggactttaacgttcacaacgaactgctgggagatgagctgactcatctgacggtactggcggcgaataatacgggataccagaacctgacgttgctgatctcgaaagcgtatcagcgcggctacggcgcggcaggcccgattatcgagcgcgactggctggtagagcttaaagaaggtttgatcctgctttccggcgggcgcatgggcgacgtaggccgctgtctgctacgcggcaaccaggcgctggtggaggagtgcgttgctttctatgaagcgcattttcccgatcgctacttcctggaactgatccgtaccggcagacaggatgaagagacctatctccatgctgcggttgagctggctgaggcacgtggtttgccggttgtcgcgacaaacgatgtccgtttccttgaaagcgatgattttgacgcccatgagattcgtgtcgcgattcacgacggtttcacgctcgacgatcctaaacgtccacgcaattattcaccgcagcagtatatgcgcagtgaagaagaaatgtgcgagctgttctccgatattccggaggcgctggaaaatacggtggagattgccaaacgctgcaacgtaacggtgcgtctgggtgaatatttcctgccgcagttcccgaccggcgatatgaccaccgaagattatctggtcaaaaaatcgaaagaggggctggaagagcgtctggctttcctgtttccggacgaagaagagcgcaaaaagcgtcgcccggaatatgacgagcgtctggatattgaactacaggttatcaaccagatggggttccctggctacttcctcatcgtgatggagtttatccagtggtcaaaagataacggcgtgccggtagggccgggacgtggttccggggccggttcgctggtggcctacgcgctgaaaattaccgaccttgatccgctggaatttgacctgctgttcgaacgtttcctgaacccggaacgtgtctcgatgcctgacttcgacgttgacttctgtatggagaaacgcgaccaggtgattgagcacgtcgcagacatgtacgggcgtgatgcggtatcgcagattatcaccttcggtacgatggcggcgaaagccgttatccgcgatgtgggccgcgtgctggggcatccgtacggttttgtcgatcgtatctcgaagctggtgccgcccgatccgggcatgacgctggcaaaagcctttgaagcggaaccgcaactaccggaaatttacgaggcggatgaagaggtcagagcgctgatcgatatggcgcgtaagctcgaaggcgtcacgcgtaacgccggtaagcacgctggcggcgtggtcatcgcgccgaccaaaattaccgactttgcgccgctgtactgcgatgaagagggcaagcatccggttacccagtttgataaaagcgacgtggaatatgccgggctggtgaagttcgacttcctcggtttgcgtacgctgactatcatcaactgggcgctggagatgatcaacaagcggcgggcgaagaatggcgagccaccgctggatatcgccgccattccgctggacgataaaaaaagcttcgacatgctgcaacgctcggaaaccacggcggtcttccagcttgaatcgcgcggtatgaaagacctgatcaagcgtctgcaacctgactgctttgaagatatgatcgcgctggtggccctgttccgtcccggcccgttgcagtcagggatggtagataactttatcgatcgtaagcacggtcgtgaagaactctcttacccggacgttcagtggcagcatgaaagcctgaagccggtactggagccgacctacggcatcattctgtatcaggaacaggtgatgcagattgcccaggtactttccgggtatactctcggtggcgcggatatgctgcgtcgtgcgatgggtaagaaaaagccggaggagatggccaaacagcgttccgtttttgaagagggcgcgaaaaagaacggtatcgacggcgaactggcgatgaaaatctttgacctggtggagaaattcgccggttacgggtttaacaaatcgcactccgccgcttatgcgctggtttcttatcagacgctatggctaaaggcgcactatccggctgaatttatggcggcggtgatgactgccgatatggacaacaccgagaaggtcgtcggcctggtagacgagtgctggcggatgggactgaaaattctgccgccggatattaactccggattgtaccatttccacgttaatgatgagggcgagatcgtctacggcatcggcgcgatcaaaggcgtcggcgaagggccgatcgaagcgatcatcgacgcgcgtaatcagggcggctatttccgcgaactgtttgatctgtgcgcgcggaccgacaccaaaaagctcaaccgccgggtgctggaaaagctgatcatgtccggggcgttcgaccgcctggggccgcaccgcgccgcgctgatgaactcattgggcgatgcgctgaaagccgccgaccagcacgccaaagcggaagctatcggtcaggcggatatgttcggcgtactggcggaagagccggagcaaatcgaacaatcctatgccagctgccagccgtggccggagcaggtggtgttagatggggaacgtgaaacgttggggctgtacctgacgggccaccctatcaatcagtatttaaaagaaattgagcgctatgtcggcggggtaaggctcaaagacatgcatccgacagaacgtggtaaagtcaccacggctgcggggctcgtgattgccgcaagggttatggtcaccaagcgcggcaatcgtatcggcatctgtacgctggatgaccgttccgggcgtctggaagtgatgttatttaccgacgcgctggataaataccagcagttgctggaaaaagaccgcatacttatcgtcagcggacaggtcagctttgatgacttcagcggggggcttaaaatgaccgcccgcgaagtgatggatattgacgaagctcgcgaaaaatacgctcgcgggcttgctatctcgctgacggacaggcaaattgatgaccagcttttaaaccgactccgtcagtctctggaaccccaccgctcggggaccattccagtacatctctactatcagagggcggatgcgcgtgcgcggctgcgttttggcgcaacgtggcgtgtctctccgagcgatcgtttacttaacgatctgcgtggcctcattggttcggagcaggtggaactggagtttgactaatacaggaatactatgagtctgaatttccttgattttgaacagccgatagcagagctggaagcgaaaatcgattctctgactgcggtaagccgccaggatgagaaactggatattaatatcgatgaagaagtccatcgcctgcgcgaaaaaagcgtagaactgacgcgcaaaatcttcgccgatctcggcgcatggcaggtagcccaactggcgcgccatccgcagcgtccgtacaccttggattatgtccgtctggcgtttgatgagtttgatgagctggcgggcgatcgcgcctatgctgatgacaaagccatcgtcggcggtatcgcgcgtctggaagggcgaccggtgatgatcattggtcatcagaaaggtcgtgaaaccaaagaaaaaattcgtcgtaactttggcatgccagcgccggaaggctaccgcaaagcgctgcgcctgatggaaatggctgaacgcttcaacatgccgattatcaccttcatcgacaccccgggcgcttaccctggcgtgggcgcggaagagcgtggtcagtctgaagctatcgcccgcaacctgcgtgagatgtctcgtctgaacgtaccggtcatctgcaccgtgattggcgaaggcggctccggcggcgcattggcgattggcgtgggtgataaagtgaatatgctgcaatacagcacctattccgttatctccccggaaggttgcgcctctattttgtggaagagcgccgacaaagcgccattggctgctgaagcgatgggcatcatcgcgccgcgtctgaaagagctgaagctaatcgattccatcattccggagccgctgggcggcgcgcaccgtaatccggaagcgatggcggcgtcgctaaaagcgcagctgctggaagatttagccgatctcgatgtgttaagcaccgatgatttaaaaaaccgtcgttaccagcgtttgatgagctacggttacgcctaatcatttacctcatttctcccaggaggccggataatccggcctcttttttgtctatggaaaaccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttattttggacgaggaaaaatgagacgccgatgagctgatgtgattaaacgcaacggcatgttctccctgacactgtagcaactgccaggcgtgtggccagggcaggcagtgaactacccttcaaggagaaaattatgggattgcaaaaaacactggcgctcagcgccgtagcggcagggatcatgttgagcttatccggtgcgcaggccgcgccgctgcttagcagtagtgagccaatgaccattaacgccagcgatctggcggcgaaagagaaagcgctgacggattttccgttaatggaggcagtgaaatcctctatccagacgttggataacagcgcggtcgaacaaatcgaaccggggcgcgccgctaacccggcaaacgtaaaacgcgttgaaagtattctgaaagaggccgaccgggattatctgttcccgatgcgcgcgccggaatacacttactctaacttcctgaaagcgataggtaaattcccggcggtttgtggtacctacaccgatggacgcgatagcgacgctatctgccgtaaaaccctggctactatgtttgcgcattttgcccaggagacgggcggtcacgaaagctggcgtgacattccggaatggcgtcaggcgctggtctatctgcgcgaagtcggctgaacagaagggcaaaaaggcggctacaacggcgaatgtaacccggatgtatggcagggccagacctggccgtgcggtaaagataaggacggcgatttcctcagctattttggccgcggggcaaaacagctttcttataactacaactatgggcctttctctgacgcgatgtatggcgacgttcgccctctgctggataaacccgagctggtggcggatacctggatgaacctggcgagcgccgtcttcttctttgtgtatccgcagccgccgaagccgtctatgctacatgtgattgacggtacctggcagccaaacgatcgcgataaagcaaacggcctggtatcaggtttcggcgtcactattcagatcatcaatggcggcgtggagtgcggcggcgcagatgagaatgcgcagtcgcttaaccgtatcgcctactacaaagagtttgccaactacctgaaagtgccggtgccggctgacgaagtgttgggctgtaaaaagatgaagcagttcgatgaaggcggcgctggcgcgttaccgatctattgggaacaagactggggctggagcgccgatactgcggacggtaaaacctattcctgccagttagttggatatcagacgccgtataccgcctttaaagagggcgactacacgaaatgtgtacagcattatttcaacgttaatgtcgtcgatgataacggaaccactgaaccggatgtcacgccaactccggcgccagtgacggatgaaaacgtggcaccagtcgcgcgcattgccgggccggtcggggcggtggaagccggtagccaggtttcactcaacgcggaaggatcgaccgacgcgaatggcgacaagctcacctatacctggatgtcgcaggatggcaaaacgctgagcggccaggataaagccgttgtgattttcaacgcgccggatgtcactcagaacacccagtatgtggtgaatctgaccgttagcgacggtacgctctccagtacagcggtttatacgctgaatgtgaaagcgaaggccgccgctgcggatgacgaagataagaccaccagctaccctgcctggagcagcagccagaaatggaatccgggcgacatcgtcaacagtaatggcgcattgtaccagtgcaaaccgttcccggaaggctcatggtgtaatgttgcgcctgcctactatgagcccggcgtagggattgcctgggccgatgcatggaacgcattgtaataagataaatcctgtcggtgctttgcatcggcaggattgttactatgcttatctcaggttttttcaggagaaagcatgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctgtttacctacgccaaagaaggaaaatataccttttgtacgccggggcatatggcgggaacggtgtatcagaaaagcccgccaggctgtctgttttatgacttttttggcggcaataccttaaaggccgatgtgtcgatttcggtgactgaactgggatcgctgctggatcacaccgggccgcatctggaagcggaagagtatatcgcccgtacttttggcgccgagcagagttatatggtgacgaacggtacgtcgacctcgaataaaattgtcggtatgtatgccgcgcctgcgggaagtacgctacttattgatcgtaattgccataaatcgctggcgcatttgctgatgatgagcgatgtggtgcctctctggttgaagccgacgcgcaatgcgctcggcattctcggcggtattcctaagcgtgaatttacccgcgacagcattgcgcgtaaggtggcggaaaccgcgcaggcgcaatggccggtgcatgcggttatcaccaattcgacttacgatggtctgctgtataacactaactggatcaagcagatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttctacatcgccgagctatcccattgtcgcctctatcgagaccgcggcggcgatgctgcgcggcaatccagggaaaagattgattaatcgttcggtggaacgggcgctccattttcgtaaagaagtacagcggttacgtgaagagtccgatagctggttctttgatatctggcagccggaagaggttgatgaggccgaatgctggccggtcacgccgggagaaacctggcatggcttcaccgatgctgatgacgatcatatgttcctcgatccggttaaggtgacaatcctgacgccggggatggatgaacagggcaacatgagcgaagaggggatacccgccgcgctggtggcgaagttcctcgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggagctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgttcgattggccagcattatcccggttttgaaacggatattcacggcgcgaaacggaatgaagacggggtgtaccaggtacgagtcttaaaacacgcctgttagcttgcctgacgagaatgtgacgagtaacgtactgataatcaataaaggagacgctatgctgggattaaaacaggttcatcacatcgcgatcattgcgacagactatgcggtgagcaaggcgttttattgcgatattctggggttcgatctgctaagcgaagcctggcgggaagagcgtgactcgtggaagggcgatttggcgctaaacgggcagtatgtgattgagcttttctcttttcccttccctccggcgcgtccaagccgacctgaagcctgcggtctgcgccatctggctttcagcgtggaaaatgtggaaaacgccgttgcgcatctggaaaagcatcaggttaagtgcgaaccgatacgcatcgatccgtataccgggaagcgctttacttttttcaacgatccggacggtttaccgcttgagctgtatgagcagtaaggcttgtcattaagacgctcgccaggtaacgttgccgggctaagtcactataagcatggatcatgaccactctcacgttgaatacctcgttactctcttctcgccgtattctggctgcctttagcggtggcctggattctacggtgcttctgcatcaactggtgttgtggcgagaacgccatcctgacgtcacgctgcgtgctatccatattcatcacggtttaagccctcatgctgatagctgggtgcggcattgcgaaaccgtatgcgaacgctggcaggttccgctggtagtggagcgggtgacgttggcggataatggcctgggtatcgaggcccatgcgcgtgaagcgcgctaccgggcgttcgcacagacgctattgcctggcgaagtgctggcaaccgcgcagcaccttgacgatcagtgtgaaacattcctgctggcgttaaagcgcggcagcggtccggccggactttccgcgatgggagaacgctcgccttttgccggaactctgcttcttcgcccgctgttgagagaaacgcggaagacgctggaacagtgggctgtgcgtcatggcttatgctggattgaagatgaaagcaatcaggatgacgcctacgatcgcaattttttacgcctgcgcgcgcttccgctcttacagcagcgctggccgcattttcctgcggcggtagcccgtagcgcgacgctctgcgccgagcaagaaaggctgctggacgagcttctggccagcgatcttacggactgtatcacgacggagggaacattgcggctctctccattaatgtcgatgagcgatgtgcggcgggcggcgattttgcgtcgctggctggcgatgcgtaatgcgccgatgccctctcgcgacgcgctggaacgtatctggcaggaggtggcgctggcgcgcgacgatgcctctccctgtttacgctttggcgatcacgagattcgccgttatcagtcgcaactgtggtggattaaaaccgtagccggacaacacgaaacgacggtcgcctggcccgtctggcaaacaccgctggcgctgcctgccggcttagggacggtacagctcgttcctggcggcgaactgcgccgaccgcgagaggaagaatccgtcagcattcggtttaaagcgccagggttgctacacattgtgggacgtcacggcggacgtaaattaaagaaaatctggcaggagcaggggatcccgccctggcgacgagacaccacgccgctgttgttttacggcgaaacgctgattgcggctgcgggtgtttttgtgacgcgtgagggagcagcagaagataaagaaggggtgagtctggtttggcatgcctgatggcgctgcgcttatcaggcctacgtatcgcatggaacgtaggccggataaggtgcttgcaccaccatccggcaacaaaatactcaggattcgctaactaccacggtaccaatttccgggtggctgaaactggcgattttatcgagacgaagttcacaagactcgccggaaacctcggcaagcagatactctacgtttttacgtaagatcaaatcgttcgcttttgcctgcaaaacctcgccatcttttaacgttagcgtcagtattaaatgatgcatgcaggcaagctcaagactatcgtagtcatcgcaattaatgggttgatacgtttcattcattgacataatcgctcaccagtaagttcgcggcagcataagctgccttttccctgaccgactctgaaagggcgctatctgccgccacttcattaagcactttcaatacacaacccagcgcatccgggacataccctaagtctccgctggcgatttccgcataccgcttgcgtactaactcacaatatttttccacatgccctcctgtcagcattctgacttaaccgtggatgcaagtctaagcctacgaagttaaatcttgtttagcaaggtgactataccatactcatttgcgcaatatcagcgcctgacgcgagtgggtaaaagattcgttaacagccttttagcgcggttttcgctacaatgggcgcctgattcgaaaggagttttctcatggcgcttaaagcgacaatttataaagccgtcgtcaatgtggctgaccttgatcgcaaccggtttctggatgcggcattgacgctggcgcgtcacccttctgaaacgcaggagcgcatgatgctgcgcctgttggcatggataaaatatgctgatgaacggttgcagtttacacgcgggctcagcgcggaagatgagccggaggcctggctgcgcaacgatcatctgggcatcgatctctggatagagctggggctgccggatgagcgccgtattaagaaagcctgtactcaggcgagcgacgtcgcgctctttgcttataactcccgggcggcgcaaatctggtggcagcagcatcaaagcaagtgcgcgcagttcgctaacctgtccgtctggtatctggatgacgggcagctggcgcagctcagtgaatttgccgatcgtaccatgacgctacaggcgacgattcaggacggcgcaatctggctttctgatgctcggaataatctggaaatacagctaaccgcctggcaacagccctcatgattgccatctcccggacggtctccatagccgataatgagctggaaattacggccattcgcgcgcagggcgcgggtggtcagcacgtaaataagacctctagcgcgattcatttgcgctttgacattcgggcctctggcctgccagagtattataaacagcgtttgctgacggccagccaccatctgataagcgatgatggcgtcattatcattaaggcgcaggagttccggagccaggagctcaaccgggaagcggctatcgccaggctggttgccgtcataaaagaattaaccgcggagcagaaaagccgtcgcgcaacccgtccgacgcgtgcctcgaaagagcgccgcttgtcctcaaaggcgcaaaaatcttctgtaaaggcgcttcgcggcaaaattcgtcgtccactggattgacgggcaggaatagcaatttcataaggattttatggtgagaacagcaatattgtcagtagcggcagcctgtacgctatttgcattgatagggtgtaataaccgtgcggaagttgacgccctgcaacctgcgcaggcggcggaattaaaacccatgcagcaaagctggcgcggcgtgctgccctgtgcggattgtgaaggtattgaaacgtcactgtttctggaaaaagacggcacatgggtgatgaacgagcgctatcagggcgtgcgcgaagaaccttcctcttttgcgtcatacggtacctgggcgcggacggcggataaactggtgttaaccgacagcaatggcgagaaatcgtattatcgcgcgaaaggcaatgcgctggagatgctcgacagagaaggcaatccggtggcttcgcagcttaattatacgctggtgcctgttaccgccagcctgccggtaacgccaatgccgctgcgtggtatgtatgtatacagggccgatgcggcgacctttaccgattgcgcgaccggaaaacggctgccggtcgccagtaacgcccagcttgagcgcggctatctggcggcgaaaggtgaagcggaaaaaccggtgctgctgacggtcgaagggcattttgtgtttgccgcgaatccggacacgggcgagccggtaaaaacgctaatagctgataaaaatgtgaagtttgcgccgggtaaagattgcactcactaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaaaggcctcgcagggtgcgaggcctttacatatctgccggatggcgccgggcaatcccaacaaaatgtcgtttagcctttaatcgccttgaccagataatcaacgatatcgccggttttaatcagcgatttttcaccgctacgacggtatttatactcaatatcgtcgttatccaggttgcgatcgccaatcacgatagtatgtggaataccaatcagctccatatcggcaaacatcacgcccgggcgctctttacgatcgtccatcagcacttcaatgccctgcgcgcgcaattcgctgtacagcttttccgccagctcctgcacacggaaggatttgtgcatattcatcggcagaatagcgacctggaaaggtgcaatggcgtcaggccatacaatgccgcgctcgtcaaagttctgctcgatagccgcggcaacgacacgtgttacgccgataccatagcagcccattgtcaggatctggttacggccatcttcaccctgaacggaggctttcagcgcttctgagtacttggtacctaactggaagatgtgacccacttcgataccgcgtttgataagcaacgttccctgaccatccggactcggatcgccggcgactacgttacggatgtcggcaacaacaggcgtcgccacatcgcgatcccagttaataccaaagtagtgtttaccgtcgatgttagcgccagcggcaaaatcgctcatggcggcaacggtacgatcgatgatgaccggaatcggcatattgaccgggccgagggagccagggccggcattaattacggcgcgaatctcttcttcagtagcgaaggtcagcgggctggcaacgtgcggcagtttttccgctttaacttcattcagttcatgatcgccgcgaaccagcagagccaccagcggagacttgctgtctttcaccgctttcaccagcagcgtttttaccgttttttcaattggcaggttgaattgttccaccagctccgcgatggttttggcatttggcgtatcgaccagagtcatttcctgcgtcgccgctgcgcgcggtgtttgcggcgcgatagcttctgccagttcaatgttagccgcgtaatcagaaacatcagagaaaacgatatcgtcttcgccgctttgcgccagcacctggaattcatgcgaggcgttgccgccgatagaaccggtatcggcctgtaccgcgcggaaatccagccccatacggctgaagatacggctatacgcggcgtacatggcgtcataggtttcctgcaacgactcctgagaggtgtggaaagagtaagcatctttcatcaggaattcgcgcgaacgcatcacgccaaagcgcggacgcacttcatcacggaatttggtctggatttggaagaagttcagcggcaactgcttataagagctgagttcattacgcaccaggtcggtgataacttcttcgtgggtcgggccgagtacgaacggacgctcgccacggtcgacaaaacgcagcagttccggaccgtactgttcccaacgaccactctcttgccacaggtcggctggctgaacgactggcatcgacacctcgatagcaccggcgttgttcatctcttcacgcacgatgttttcgacttttttcaggacgcgcaggccggtcggcagccaggtatataacccggaggcgagcttgcggatcatcccggcgcgcagcatcagctggtggctgataacctcggcgtcggcaggtgtctctttcagagtggagagcaggtattggctagtacgcatgttgttacggttccagttgaacgatcgaacaggctcaatgtgagcctgatacaaaaaaagtgatttagtttaccagcgtgcaagagatgtcaaaagagaagggcgtgaaattaccgtggttccagcgcaaacacttcaaatccggtgttaaccacacgccagcgcacgttaaaatcatgcagccagacggcataggttttgcccgtctcttcacccttacgataagccgggcgaggatcttgcgccagcacatcgcaaataaatgtccgtagctgcggataacgcctttccagcgtcgtaagctgttgagccacttcagcggtaaaactcacaggcatttcagctatcggcgcctgttgcgcatagctggcggcggcgtccggtaaggcctcggcaaacggtaaatacggtttgatatccaccaccggcgtgccatccaccagatccagactgcctaatttcagaattacgctctctttccggcactcgataccttttagcgcaacgagcgacatgccaatcggattggggcggaacgtggagcgcgtggcaaaaacgcccattctggcgttaccgccaagacggggcggacgaactgttggccgccagccgccgtccatcgtctgatgaaaaacgaaaagcacccacaaatggctgaacgcttccaggccgcgaacggcatcggcctggttgtaaggcgctatcagatgcagttcgccgcaggcgcttttgaccagaccaggctggcgcggaacggcgaatttttctttatagggggagcgaataacgccgatttgatcaaactgaaagctgctcatttcgccgaaatattcagggcggacccgatacaaaccgcctgacggtagcagcctggcgtgccgctggtaatttcacagctgtgcagcaggacggcgttggctttcattttagatgcattaatctgcatacgcttgcgcgcagttggaatgttaggcggagagtcttgatttgtcgcctggcaggattcgccgctaacctcgccaagatcgcggaaaggtttgccgactaagtcttcagcattggtgtaaatcctgacgggagcggcacgcggcgctttaggtttctccggctccgcttttggcggggttgcggtgctttgaacaggttcaacaggggatctgcttagcatggaacaaccgcccagcatgagtgccaataaacagatcggtaaagcacgcataatatttcctcaatgaatgttctaattgccagatattgaatcaggagcttgcataaatgacaagacgggcaatagcccgtcctgaataatattacagattgtggaatcagcctaaaacttaccagcctttcaccgcgccgccattaaaaactttatttgcggcttcgtacacttcatcagactggtaagcctgaacgaattttttcacattctcggcgtctttgttatcttcacgcgtcacgatcaagttaacgtacggagaatctttatcttcaacgaagataccgtctttcgctggcgtcaggccaatctggctggcgtaagtcgtattgatgaccgctaacgcgatctgagcgtcatccagcgaacgcggcaactgcggcgcttccagctcaacaattttcagatttttcgggttttcgacgatatccagcgaggtaggaagcagactgacgccgtctttcagtttaatcagccctactttttgcagcagcagcagggaacgaccaaggttggtcgggtcgttaggcacagcgacctgggaaccgtccttgagctcatccagagatttgatttttttggaatatcctgcaatgggatagacaaaagtcttaccaacggaaaccagtttgtagccgcgatctttgatttgctgatccagatacggtttgtgctggaaggcattggcatcgatatcgcctttgctcagcgcttcattaggcagaacataatcattaaaggtcaccaattccacgtccaggccgtatttttctttcgcgactttctgcgcgacttcggcaacttgctgctctgcgccaacgattacgccgactttaatatgattcggatctttttcatcctgaccgcaacccgcaagtgccagagaaccaatcagagcacccactgccgcaaaggttttgaatttgaacgccatgcttatttccttaatgagtatttgtgttgtgtttaacgttacttatgcgtgacagccctgacgatgcgatcgccggataactgaattaaataaaccagaacgacaagtaataccagcaccgtattcatcacggtagcattgtatccaatataaccgtactgatagccgatttgaccgaggccgcctgcgccgacggcgccgcccattgcggagtaaccgaccagggtgattagtgtaatggttgccgcattcaccagaccaggcagcgcttccggtaaaaggattttacgtacaatttgcagcggcgtggcgcccatcgctcgcgaggcttcaatcagcccggcagggatctctaacaacgcattttccactatacgggcgataaaaggcgcggcgccgacggtcagcggtacaatcgcggcctgcaaaccaatggaggtgccgacaattattcgggtaaaaggaatcatccacaccaacaggatgataaagggaatcgagcggaaaatattgaccaccgcagagagggagcgatacagcctggcgttctccataatctgccccgggcgcgtaacatacagcaatacgccaaccggcaggccaatcacgaaaccgaagaaaccggagacaaaggtcatcgccagcgtttcccagacgccacgaaccagtaaccacatcattgcctcagacataacccagtacctctactttcacatggtgatcctgcagccaggcaattgcggcttgcgtctcttcttgtgtgccgtgcatttccgttagcataatgccgaacttcacaccgcccgcgtaatccatctgtgcgctgataatattattgttcacgttgaaacgacgcgcggtttcagaaagcagcggggcatccacagactgtccggtgaactccatgcgcagcatcggcacgctgtcagtttccggcgacgctttcaaacgcgcctggtaatcttccggaatgtccagatgcagagtggactgaataaacttctgcgccagcggcgttttaggatgcgagaagacttcgctgaccgtatcctgctcaataagctcgccattactgatgacggcaacgcagtcgcagatacgttttacgacatccatttcatgagtgataagcagaatcgtcaaccccagacgacggttgatatctttcagcaattccagaatcgaacgggtcgtcgcgggatcaagcgcgctggtggcttcatcgcacagcaacacttttggattactggctaacgcgcgggcaatcgcgacacgctgtttctgaccgccggaaagatttgccggatagctgtcgtgcttgtcgccaagaccgactaaatccagcagctctgtgacacggcgtttgatctcttcctttggtgtgttatccagttccagcggcaacgcgacgttgccaaacacggtacgggaagagagcaggttaaaatgttggaaaatcatgccgatttgacggcgagctttggtcaacccggactctgaaagcgttgtcagctcctgaccgcctaccattacgcttccttcagtaggacgttcaagtaagtttacgcagcgaatgagcgtacttttaccggcgccggaggcgccgatgacgccgtaaatttgtccggcagggacatgcaggctgacattgttcagcgcctgaatggtgcgcgccccctgctggaacactttggtaatattcgaaagtttaatcattgattctttattatcgtaatgaaatgagcggaggcattttcgtctgcctaatacggtcaacgccgtcaacagaatggatgttaaggcatccagacgtctaaatcaatcaggctttatacgatgagcactttcttgcctgctgaaacatgcgatactagcgccacttgctttactcaggagctataaaaggtggcaaagtctgtacccgcaatttttctcgaccgtgacggcaccattaatgtggatcacggctacgtacatgaaatcgatgcatttgagtttatagacggcgttattgacgcgatgcgcgagctaaaaaaaatgggctatgcgctggtggtggtgacgaaccagtccggaatcgcgcgcggcaaattcactgaggcgcagtttgaaacgttaaccgaatggatggactggtcgttggcggatcgcgatgttgatttggacggcatctattattgtcctcaccatccgcagggcagcatagaagagttccgtcaggtatgtgattgccgcaagccgcatccaggaatgcttatctcggcgcgtgatttcctgcatatcgatatggcggcttcttatatggtgggagacaagctggaagatatgcaggcggcagcggcggcaaatgtcgggacaaaagtgctggtgcgtacgggcaaaccggtcacggcagaagcagaaaacgcggcggactgggtgttaaacagccttgctgacctgccatcagcgataaaaaagcagcaaaaataagcgttatggataaaagatgagcggttaaaacaaaaatgcatttttccgcttgtcttcctgaaccgactccctataatgcgcctccatcgacacggcggatgtgaatcacttcacacaaacagccggtcggttgaagagaaaaatcctgaaattcagggttgactctgaaagaggaaagcgtaatatacgccacctcgcgacggtgagctgaaagccgcgtcgcacctgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttaccttaaagaagcgtactttgcagtgctcacacagattgtctgatgaaaagtgaatagcaaggcgtcttgcgaagcagactgatacgtccccttcgtctagaggcccaggacaccgccctttcacggcggtaacaggggttcgaatcccctaggggacgccacttgcgcggtaatgtgtgaaaggcgttgccatcagtatctcaaaactgacttacgagtcacgtttgagatatttgctctttaaaaatctggatcaagctgaaaattgaaacacagaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagccccaccactaagccagtggtgaactccacatacgcatcctttgctgaggagacggttaacggagcgaaagcgacgttcaacctcaaaagaagcagagggggcttagtggtggggtgactgcgtaccttttgtataatgggtcagcgacttatattctgtagcaaggttaactgtataggggagccggagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaatgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacaccgtgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtatgtgttccaggtaaatccggttcactttaacactgaggcgtgacgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcacggagctgaagtcagccgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagactttaggtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagacgattttcagcactgattccggattttcgggaacgaaagataaaagattcgtttccggcaacagaatttgcctggcggcactagcgcggtggtcccacctgaccccatgccgaactcagaagtgaaacgccgtagcgccgatggtagtgtggggtctccccatgcgagagtagggaactgccaggcatcaaattaagcaaaaggctcagtcgaaagactgggccttttgttttatctgtggtctgccggtgagcactctcctgaggaggacaaatccgccgggagcggatttgaacgttgcgcagtaacggcccgtagggtggcgggcagcacgcccgccataaactgccaggcatcagacaagtgaagaagcccgttctgacggacgggcttctttgcgtgtgtggtaactgtaaaaatgtaggcctgataagcgcagcgccatcaggcaacctgcaccgccggatggcagcttcgccttatccggcctacagcaattatcccgcctacgaagctggtgctcttgtagaaccgataagagcacaacccacccaatcgttaacgatgaactatcctttacacgtgcttatataagcagtgaggattttcattggctatcaaaccttttaactaccagcaagacttttccagcattgacttccgccagcagcctgaattgtatcaggttggacgaggagagcagggggggctactggttgaaccctacaaaagcgaaattcttcctttctggcgctataaagatgaagcatcggcgatgaaatccgcagaacagatctaccagttgttcgaagcttaccggcagcaggatgatttcgttggtatggacatggcgcgtaaatttattcagatgggatacacccgcgccaggcgatacgctaactataaaggtggtaaaaagtatgcagaagacggcagcctgaatacacggggtaatgatcctattaaggccgcggcggcaacggttttcaaaggttggtgggataaaatccgtcaggacgaagactatctgaaacggaaacgccagcatcaggcacggtggggataaaaattagcagacaaataattaacactttatttactttttagtctcgcgtaatctgaatctccaaaataaaaggccgattaagcctggcaacaaggagaacagtatggcagaaattattcagcgtatagataaaaacaacgctgaggctccggagatgcggcgacacatatgggctatcgtgggggcctcttccggaaacttagtggaatggtttgatttctacgtctactctttctgctcgctctattttgcacatatcttctttccttctagtaataccactactcagcttttgcaaacggcaggcgtctttgccgccggttttttaatgcggtctatcggtggttggctgtttggacgcattgccgatcgacgcgggcgcaaagcctcaatgttgatttcggtgtgcatgatgtgcatggggtcgctggtgattgcctgcttacctggttacgataccatcggcacctgggcaccggcgctgctacttattgcaaggttatttcaggggctctcggtagggggagagtatgggaccagcgcgacatatatgagtgaagttgcgcttgaaggtcgtaagggatttttcgcgtcgtttcagtacgttacgcttatcggtggccaactactggcattgctggtcgttgtgattttgcagcaggttctggaggatgctgagcttcgtgcctggggatggcgtattccctttgcgctgggcgccgtgctggcggttgtggcgttatggctacgtcgccagctggatgaaacctcgaagcatgagactcgcgcattaaaagaagccggttcgttgaaaggtttgtggcgtaatcgcaaagcctttttgatggtgcttggtttcaccgcggcaggctcgctgtgcttttataccttcaccacctatatgcagaaatatctggtaaatacagcaggtatgcatgccaatgtcgccagcggcattatgacggctgcgctgtgtgttttcatgttggtgcagccgttattcggcgcgttatccgataagattggcaggcgcacctctatgctatgttttggcgcactcgcgacgcttttcaccgttccaattctctccgcgttgcagaatgtgacgtcgccttatgccgcatttgctttagtgatgtgcgcgctattgattgtgagtttctatacctcgattagcgggatcctgaaagcggagatgtttccggcgcaggttcgcgccctgggcgtcggtttatcttacgcggtagcaaacgcgttatttggcggctctgcggaatatgtcgcgctgtcgctaaaatctgtcggtatggagagttcgttcttctggtatgttaccgcgatggccgttctggctttcctggtttcgttgatgttgcaccgtaaaggaaagggcttacgcctttagtatcgcgccatttgccagatagcgtaaccggttgtcgcgccagcgacatcccagacaaaatctttccagctccagccgctgccttccgggcggctgtcccagagttcttttgaggctccgagactcaaagaaaacatcagccctatcgctgcgctgcggtcagggcttactccctggtgacgcgcatactcattaccggctgccgatagcatcgctgatgccataaaatgctgggctttatcctgaccgctccagtggtcgttagccagatggctgcacccggagagaaacaacaccgtaaaaggaatcaacacgcgcaccagttcactcctaagagaaaaccccgtacaggacggggcttcgattacaggatacggctaattaatctgtcgatgcggatccggcgcagacggcgaatcaatttacgcacttttatcggatagtcggcaatgctctgcaggtcacgataatgttttacgatggttgtgtgcgttcggataagttccagctctttttcccgctgaggggcaagctcttgcttaggatcgtggatcagaatggcgttttccagatccagacgccaggcgcgaggattcagattgttgccggtgagtagcatccatttatcatctacccacatccctttcaaatgataggtattgtcgtcatctttccacagacgcaccacaagctgatcggtattgacgtaatactgtaaacggctcaggaagcggcgcaggttaatctcatagagatagggcagcgcgccaatgatcttgaacggttcatcttccggaatgtaaaaatcattcgcggttttatcgccaacaatgatttcgactttctttccgtcgcgcagtagctgaataatattccgcaccagtaccgctggtagattgaagtaaggggtacaaatggtgagcttatgctccgcacagggcatgagatggaaaatggttttgttcagcagactggattttccaagcccgaccagcggcgtaacggagagctgctcgtcattagcgtcaccctgaaaatgatatgacgcatcacgcagctcctgacggtataagcggatatcgtttttaatctccgggcttttcggccgctgggtattatccagacgattcacaccacggccattcatcagattttgcgtcacccagtcaaacatgatgtctgccatttgccgattgcgaatcagctggtagcgatcgtagcgatatttgtcatgctgatggagatagacatcgttcaggctggcgccgctgtacaggacgctatcatcaatgataaagcctttaaaatgcagtacgccaagcgcttctcgcgtattaatcggcacgccgtaaaccgggacatcaatgccggggttttcctgcgccagtcggcaataccagtctgcattggtattcgaggccgctgcgccaatgcgcccgcgttgcgcgcgatgccagtcgaccagcaccctcacgtccagttcaggacgctgccgtttagccgcatagagcgcgtcgagtatacctttacccccatcgtcctgttccagatacagggcaacgatacaaatacgctgcgtcgcgctggcgattttctccagcagtgtctcccgaaaagtagcaggagtataaaagaaatctacatcatcaactgactgagaaatcttagggagttgggcaaggtgttgttgatgtttattacgcttaaattttgacaacatcacagtgcatttcttctctgttcattgaagggtcctctgtgctatgcagacgacataagcgagcaataataacatcagtacccgttaaagtggtcaacatttccagtacattactcacgattcatcacatttggccagattcagcgtcaatcccacgatgccctcgtcgagctgaatatcgacctgaaatcccagttttctggccagcgcgaccatgccgcgattgttcggcatcgtaataccgttcagccgcttcaatccgtgatcgcgagtataggcaatcaatttctccattaaacggcgtcctaaacccaaccctttaagatctgaacgcaccaatacggcaaattcggcatctacgttgtcaggatcggagatcgcgcgcgttacgccgaggatctcttcagcgttgtccatccgcctcacggccacaaaggccatttctcgatcgtagtcgatctgcgtcatgttggctaaatcttcatgggtgaattcgttgatctcgctgaaataacggtagtaaagatcctctttggtgacctgtgcgatgaattgtcgcagttggggctcatcttccggcaggatcggacggaacaggcagcgatcgccgtttttcatctccacccactcttcaagctggtggggataggggcgtaccgcaagacgactttcgttatcgccatcaaacggggcaatatccagcgtcacatccagcgcggtaaactcactggcggaagccagcagcggatggatatccagacgctgaatttccgggcaatcgacaatcaggtttgaaacctggaccagcaattggcttaaaccgacaatatccagcggacgcagcgcgctacgggcgcgaattttccgctgtttaatgccctgaatcaccagatagcgcgccagattcatgttgagcggcggcagcgcgacgacggcctgctcttccggacgccactctacgccgccttcacccaacataatcaaaggaccaaacaccggatcgtgctcgaccaccacacgcagctcctgcgcgccggcgcggttagccatgctttgtaccagcaaaccgtgaatccgcgcctgcggccaggccatctttacacgatcgaaaatggcgttcgcggcctgttgtacctcgcttgcggtgcgcaggtaaagcatgaccccctgaacttcagatttatgcggaatgtcgggcgagcgcagcttgagagctaccggatagcctatctgttcggcgatatgcactgcttcagcgctgtcgctggcaatccaggttgggagcgtgtgcagcccataggcgtgtaaaatcggctgtacttcatgggtatccagtgaagtggcgccttccgcaatcgcccgctgtaacagattatgcgcctcagcggtattggacgtcaggttactcggcaacgctggcgtttcccgcagttgcttctggttacgccggtattccaccatgtgcataaacgcggtaatcgtgccttccggcgtgcggtaggttggtaatccggcttcgctgaacagccgtcttgcttcctgagatgagaactcgccgcaccagtttgtcagcagcgtaacaaacttgcctctggggtggcgcttaatcgtctcgatcagagcatgggcgctttccgtacccggcgcggcagcgctgggagagtggataaccataagcgcgtcaaaatcctgactggcgagcaggatatccagcgttttgacgtaatgttcgctgctggcgtcatcacacagatccagcggattggcaatatcaatgtgcgcgggaagcgtctgccgtagttgcaggcaggtctcttcgctcaatgtcgccagcttgccgttacgcgaccacaactcatctaacgccagcgcggcaggcgcggcgccattgctgatgatcatcagtctgtcgccgtgtagcggacgcatatggctaagtgtttcgacggcggaaaaaagctcgtgcgtatcctggactcgcagcaggcctgcgcgctggatggccgcatcccacgcagggtccattcccgcgctggtattaagtaaacgctgggctgccgggcttcggccgcttttaatcaccagaatcggtttgttacgtgaagcgctacgggcggcggaaacaaaacggcgggcgtcgcttaactgttccagatagagcaaaattgcgctggtcttgctatcgcgcgccagatagtccagtagttcatcgacatcaatatccaggctatcgcccagcgcgataaagtaggaaaagcccatttcacgctgttgcgcccagtcaagaatagtattggacacggcggcagactgggaaataaaagcgagcttgccctgtttaatcgggacgggagaaaagctggcattcagcccttgccacggcgcgaggagcccaagactgtttggacccagcagacgcattttataatgccgggcactggcaagaagttcttcatgttgcgacgtgggagcagaaaggataatgcacgttttacaacctttcgcgccaagcgcgtccagtaacgccaggttacggctggcgttagtgcataaaatagccagatcgggggtgaaaggaagactggcgatatccggccaggccatgacgcctaaaacggctttccaggcgggcgtcacgggaaggacggggccattgaatccgcccgccaacaagttacgcatcatcaggtaacccgcgcggtggggcttcattgatgcgccaatcaccgcgatcgattttggtcgcagtagcgcttccagtccttgctggctcataccggtttcccttacacagaagtgaccggataattttaaacgctttcgctattttatgctgtgacgtttcccggatgttgcgtttttcctgccagatagcgcgttttgaaacggatgaaatgttcacctaaactggttgccgcctcgggatctcccgccagatctaacaacgctatcgcgacttcggcggtacaatattgcccttcggcatggatttcacgcagacgataagctgaaagacgcgataaatcgacggaaatgaccggcagatgatccagataagggcttttacgaaacattttacgtgcttcgggccaggtgccgtccagcataataaacagcggcggtttcccggcgggcggggtggaaatgacctcgcgcgcttcgccggcgtaggacgcaggaaagaccactatcggctgataatccggatgctgtaccagctccagcaacgcctgcggcggctcggtacgcgaccactgaaacgccgcggtatctggcaaaatatcggctatcagccggccggtattgctgggtttcatcggttcagtgtcaaacatgaccagacaaaaacggcttttcgcctgagaaggcgttaacgtatcacacaggcaagattttagcggcagcaggcagcgttgacagcggcgaacccgattgcctctggcaagaaaagggcgagtagcgcgcgcaagccgttcggcgcgtaactgaaggacagcgttattggtcatagaaagcgtttgcggagaaaaacgctattgtggcagaggtgaaaacggggcacaagatgcgccccgtggcgtttacagcgcttcgttcagccagctgtcgaaaggcgctttaggcactgcgccattaagcatatcgaccacctgtccatgtttaaaaatcataatcatcgggatgctgcggataccgaaacgagcgctgagttcccgttccgcctcggtatttactttgacgaaacggactttaccgctgcgctcttctgcgacatcctcgaagattggcgcaaagttacggcaagggccgcaccagggtgcccaaaagtcgatcaccactggaagatcgtccttcaacagtttgtccagcgtttcgccggtcgcattaatgacttctccgtcaaacaactcatgaccgcagcgtccacattttgccgcgtcctgaagccgatcgccggggatgcggttaatggcctgacaatgggtacaaacggtgttcatagctaacctctgaatacgtcggaagacgtcccgctacgcgcgggatgtttctataatgttatatattatcgaggagtctgtgctaaacaacaatgtgttttattcaatgagtacaatagtcgcaagcttttaaacgaaatcatggctaaccggatgcacatcgggtaatcttcgcgcttcgcgcagcgctggtggagaaaagcatgaacgatgaattaaaaaacaaaagcggcaaagtcaaagtgatgtatgtccgtagtgatgatgactctgataaacgcacccataacccgcgtaccgggaaagggggaggccgcccagcaaagtctcgcactgacggtggacgtcgccccgcccgtgatgagcgaaataatcagagccgtgaccgtaaacatgaaacttcgccgtggcgcaccgtgtcccgcgcgccaggcgatgaaacgcctgagaaagtcgatcatggtggtattagcggtaaaagttttatcgaccctgaagttttgcgtcgccagcgtgcggaagagacgcgcgtctacggcgaaaatgcctgccaggcgctattccagagccgtcctgacgccatcgtgcgcgcatggtttatccaaagcgtaacgccgcgttttaaagaggcgctgcgctggatggcggcgaatcgtaaagcctaccatgtggtggatgaagccgaactggcaaaagcttccgggactgagcaccacggcggcgtgtgtttcctgattaaaaagcgtaacggtacgaccgttaagcaatgggtaaagcaggcggcggatcaagactgcgtgctggcgttggaagatgtcgctaacccgcataatctgggcggcatgatgcgtagctgcgcgcacttcggcgtgaagggcgtggtggtacaggatgcagcgttgctggagtccggcgcggcgattcgtaccgcggaaggcggggcggaacatgtccagccaatcactggtgaaagcattgttgacgtactggatgactttcgtcaggcggggtacaccgtggtgacgacgtccagcgatcgcggtcaggcgctctttagtacgaccctgccggaaaagatggtgctggtcttaggccgtgaatatgactacctgccggaagcggcgcgcgaacccgacgatctgtgcgtgaaaattaacggcaccgggaacgtggaaagcctgaatgtgtcggttgcgacaggcgtactgctcgccgagtggtggcgacagaataaagcgtaagggctgcagcccggtgacgcaacgcgcgccgggccaatgatgtactttctaccgcccggtcagacaaggcgctttcgcgccgttatccgggcgataaaacggcgagtcgccaacgttattcactctcagccggtaatactggcgtccagtcgatagttttctcgccgtgttgttccagccattggttcgttagcgcaaaatggttacagccaaaaaatccgcggtgcgcagagagtggcgagggatgcggagctttcagaatatggtggcgctgtggatcaataatcgcgcctttcttctgggcgtgcgagccccacagcaggaagacgaccccttcgcggtgttggttaatcaggcttatcactttatccgtaaaggtttcccaccccaggctggcatgagagtgcgcctggcctgcccgtaccgtgagcaccgtattcagtaacagtacgccctggcgcgcccagctttccagataaccgtgcgcggggcgaacaaagccgggaatggaggcttccagctctttgtacatattcactaatgacggcgggggagcgatcccaggacgcacggaaaacgccagaccatgtgcctggccggggccgtggtaaggatcttgtcccaggatcaccaccttaacgtcgcccagttccgtgaagcgaaaggcgttaaatacatctttttgcggcgggtagaccgtgatacccgactgacgctcgccagcaacagtgtgaagcgtattgataaagtaaggttgctgtttctcatcagccagcacatcgtgccaggttaactcagtcgccatctcgctctcctgcgaatttccagttcccttagcttaactgcttctttctgcagtgcaaaatcctgcgtgctacaaaaacggttacctacaaaagatagttgaaaatttatgtaaaaagtttataggtctgaatggtgtaagttgatgtaaaacaataaattcccttcatcaccctttttatggtgtggtttttattgatttaaatcaaagaatgaagggtgatcgaagggtatatatacactcaagcaacaatggttttaccaattggccgggattaggccgaccgaaatcaaataattttgcctggggaggcatcacatgattacaggtatccagattactaaagccgctaacgacgacctgctgaattccttctggctgctggacagcgaaaaaggcgaagcgcgctgcatcgttgcaaaatccggctttgctgaagatgaagttgtggctgtcagcaaactgggcgagattgaataccgtgaaattccgatggaagttaaaccggaagtacgcgttgaaggcggtcagcatctgaacgttaacgttctgcgtcgtgaaactctggaagacgcggttaagcatccggaaaaatacccgcagctgactattcgtgtttctggttatgcggtgcgttttaactccctgacgccggaacagcagcgcgacgttatcgctcgtacctttaccgaaagcctgtaaggcttatccggtaataacaagcggaagaggccgggccttttccgcttttgttttatttgtgtcagtaaaaaatccgcaccgcgcagtacaccagcagtaacgccagaatgatatttaactggcgaccataatggcgaaacgcccgctgaaacagatgtcccgccagcgcccagcacacattaccgaacgtgccgatcaatgccagcaatatactgacgccgatgacccagttcagcgcctgcgtttgcggtaaaacaaatgtagacagagcggtaatgccgtacagaataattttgacgttcacaaactgcaggccaaagcttacccaaaagccaaccggttttggtctgaccttctcatccgccgctggactggtggcaattttccacgccagccacaggatatacgcagcccctacccaactgagcaaatgaatgattgccggatcgataaccgcaagggaaaacgcgatcccggcgcacagcagcatgacgaccaaaaatcccagactcatacctgccagtacacgaatactctgccgaaaaccatgtgcagttgctgcgctaagcgcgagaatattgtttgggccgggggtaagggcggtgattaatgtataagtccagaaagcgcttaaaagcatcggtgtcacttgtcatctcctctgttttagcagacagtacccgatatgaaatatttaaaaaaatgaatgttttttaattctgaattcgagattttcgataggttggtggttatggatctgcgtcggtttattacgctgaaaacggtagtggaagagggctcgtttctgcgggcttcgcaaaagctgtgctgtactcagtcgacggtaacttttcatattcaacagcttgaacgtgagttttccctgcaactgttcgagaaaatagggcgccgaatgtgcctgaccaatgaggggaaaaagctgataccgcatatccatgaactgacgcgtgtgatggagtcgattcgtgaagccgcaagacaggatgcggaacccggcggagagctgcgcgtggcgacaggtgaaaccttactggcatacaaaatgccgcaggttttacaacgttttaagctgcgagcgccgaatgtcagattgtcgctacagtcgctgaattgctatgtgatacgtgatgcgttgctgaatgacgaggtcgatctgggcgttttttatcgcgtaggtaatgatgacgcgctcacgatgcagcaactgggggagcagccgctggcgctggtggcctctccactgctacaggatgctgattttacgcagccagatcagcatatccctgcagcttcatcatcaatgaaccgcaatgtgtcttccgccagctatttgaaagtacgctacggcagaggcggattacgctggaaaacaccattgaactgtggagtattgaaagcattaaacagtgtgtggctgctaacctgggcatcagctttttaccgcgatttgccgttgaacgagaacttagcaccggtcagttgaaagagctgccgtttggcgcgccgtcgctatcgatcatggcgctgtgcgcccatcatgccgggaaagcggtcagcccggcaatgcagatatttatgcagtgtatggaggcgtgttttaccgtggaagataaaaaatgccgggttaacgaacccggcattatcatcactcttcgctggattgctcctgcattttcgtaccgcttggcttgcggcgcttaccgatattttttgtatcgcggtaacgtttcttcacgcgcggcttctctttttctttctcttttttcttctcggcgcgtttcgccagcacttttttcgacggtttgccggtcagcttttcgctgggcgcacgcgtggtcgggcgaagctcatcaatgacgcgcgcttttagcggctcttcgatgtagcgaccgattttcagcagcaacagatggtcgtgggcttcaaccagcgagattgcagtgcctttgcgacccgcacggcctgtacgaccaatgcgatgcagataggtatcgccactgcgcggcatgtcgaagttaatgacgtggctgacgtcaggaatatcaatcccgcgtgccgcgacgtcggtcgcgaccagcacgttaacgcgaccgtcggtgagacgcttaataccctcgttacgtttgatctgcgccatctcgccttcaagatagcaattgttgatccctgccagacgcagcgtttcagccagttcatggacgcgttcacgtttacgtacaaacacgatagaacgggttgcatcgtcttgttttagcaggtgcttcaacagcgcaactttatgttcgaaattgtcggcacggtagtaccactggtgaattttcttgcgctcgcgggttgacggattggcggaaacctcaaccgggtcttccagcaggcgctcggcaaaatctttaatcgcatcgccttccagcgtggcggagaacagcatcgtctgtttacgccagcgggtctcaccagcgatatgttcaatgtcctgagcgaagcccatgtcgagcatccggtcagcttcgtcaaggatcagtgtttcaaccgcccggcagtcaaaattctcttcttttatatattgcagcagacggcccgtcgtggcgaccacgatatcctggttttcgctaaacacttcagcatggttcatataggccacgccgccggtaatcgtggcgatatccagatgagtatgcttagccagttcacgagcgtgatcggcaacctgcattgccagttcgcgggttggcgtcaggatcagaatgcgcggcggccccgattttttacgcggaaagtcgagcaggtgctgcaacgccggcagcagatatgccgccgtttttccggtgcctgtcggcgcagaaccgagtacatcacggccatcgagcgcaggcggaatggcggcagcctgaatggcggtcgggcgagtgaaacctttatcctggagggcatccagcaggctttcgtcgagttcaagttcggaaaaagtcgttacagtcatgttctacctctgtgtggggcgctgattatagacgttacggccgcaatcttcatctgtttgtatggatatcccttctcaggtattgttttcactcggcgctgtcgccgttttttgcaaggttgtttttacatgtctcagtctggctccgttcttcgtcgtaacggatttacgtttaaacagttttttgtcgcacacgatcggtgtgcgatgaaagtgggaactgacggtattttactcggggcgtgggcgccggtcgcggatgtaaagcgaattctggatatcggtactggaagcggtctgctggcgttaatgctggcgcagcggacggatgacagtgtgcctgttgacgccgtggaactggatgccggggctgccatgcaagcgcaggaaaacgtggctcactctccatggccgcatcgaataacggtgcatactgacgatattcagcgttgggcgcctcgccagacggtacgctttgatcttattatcagcaacccgccttattacgaacccggtgtggaatgctccacgccgcagcgggagcaggcgcgttacaccgctacgctggatcaccagacgttattggctattgcggcggattgtattaccgaagatggctttttttgcgtagtcttgccggaacaaataggtaacgcttttacgcagcaagcgctcaacatgggatggcatttgcggttacgtactgacgttgcggaaaacgaagcgcgcttgccgcaccgggttttgctcgcattctccccgcaagccggggagtgctttagcgacagattagtaattcgcgggtcagaccagaattattctgaaagttatacggcgctgacccaggcattttatctgtttatgtgaggcgttaacggcgaaaggatcgatgggcctgattcagccagttgttgcggataatccagcgtaaagtgcagcccccggctctctttacgcatcatcgcgcaacgcacaatcagttcggccacttgcaccagattgcgcagctccagtaaattattcgagacgcgaaagttggcgtaatattcgtcaatctcttgttgcaacatagtaatacgccgtagggcgcgctccagccgtttcgtcgtgcgcacaatccccacatagtcccacatcagcagacgcagttcgtgccagttatgctgaatcaccacccgctcatcggcgttctccacgcggctttcatcccaggcgggaaggacgtcaacgctgtggacagaaggcattcgcctgtcgatatccattgccgcggaccagccgtacactaagcattccagtaacgagttggacgccatacggttagcgccgtgcagaccggtgtaactgacttcgccaatggcatataagccgtctacatcggtacgaccataatcatcgacgaccacgccgccgcaggtatagtgcgcggcaggaacaatgggaatcggttctttggttaaatccatccccaaatcgagcagtttcgcatagatcatcgggaagtgctggcggacaaaatcgtcaggcttgtggctgatatcgagaaacatacagtctgcgccgagtcgtttcatctcatgatcaatagcgcgggcgacaatatcgcgcggcgccagttcgccgcgttcgtcaacgtccggcataaaccgtgaaccgtccggacgtttaaggtatgcgccttcgccgcgcagcgcttcggtaaggagaaaattacgcgcctgcgggtgataaagggcagtgggatgaaactggttaaattccagattagcgacccgacagcccgcgcgccaggccatcgcgataccgtcaccggaggaaatatccgggttagtggtatattgatacacctttgaggcgccgccggtcgccagcaccaccgacttcgcatgacaggtttcaacccactctttattgcgattccagatccaggcgccgacgacccggcgaggccccggcagacctattttatcggagataattaaatcaacggcgttgctgcgttccagcacctgaatattaggatgattttgtgcccgactgaccaacgtggtttcgacttcctttccggtagcgtcggcggcatgaaggatacggcgatggctatggccgccttcacgcgtgagatgatagctctccttgccgtttggctggacatgcgtatcaaacaggacgccctgatcgataagccactgcacgcaggtacgagcgttgctggcgacaaactccaccgcgtggcgatcgcaaattccggcgccggcaatcagcgtatcttcgacatgcgatgcaatgctgtcggtttcatcaaacacggcggcaataccgccctgtgcataaaacgtggagccctcgctcaccggccctttactcaggacgataaccttatgcttttcagccagacgcagcgccagcgagagtccggccgcgccgctgccgataattaacacatcacaggacagttcaggagttgtcatcatggttcttgtttaatttactaaacatggttgcggcagattagcactatatggcgctaaaaagcacgttatgatttcaaaagtgttgtgcttattaaacataaaataaaaatacggcgagagataaacggcaaaaaatattttatagggcagggtgttagcgtcggattttgtagtgaaataaagatgctgttaggttactctgcaaacgacgaaatgggcatttctgtacagatagtgcgttgttcagcatctgtagacttataatggaagataagacctgtctacaacatgacaaacaaaaacaaatgcgtaacggaactttacgaaacatagacactctaacctgttgcttgctcatagtgcggcttatggagtggcgtttcgaaagcgcgtggaaatttggtttggggagacattacctcggatgagcgagcagttaacggaccaggtcctggttgaacgggtccagaagggagatcagaaagcctttaacttactggtagtgcgctaccagcataaagtggcgagtctggtttcccgctatgtgccatcgggcgacgttcccgatgtcgtacaggaatcatttattaaggcctatcgcgcgctggattctttccggggggatagcgctttttatacctggttgtatcgtattgcggtcaataccgcgaagaactacctggttgcgcaggggcgtcgtccgccttccagtgatgtagacgcgattgaagcagaaaactttgaaagcggcggcgcgctgaaagaaatttcgaaccctgagaacttaatgttgtcagaagaactgagacagatagttttccgaactattgagtccctcccggaagatttacgtatggcaatcaccttacgggagctggatggcctgagctatgaagagatagcggctatcatggattgcccggtggggacggtgcgttcacgtatcttccgggcgcgggaagctattgataataaagttcaaccgcttatcaggcgttgacgatagcgggatactggaaaaggtattaggcatgcagaaagaaaaactttccgctttgatggatggcgaaacgttggatagtgagctgctcaaagcgcttacgcacgactcggaaatgcagaaaacctgggagagttatcacctgatccgcgattcaatgcggggggatacgcctgacgttctccatttcgatatatccgcccgcgtgatggccgctattgaaaacgagccagtacgtcaggtgacgccattaatccctgaggcccaacccgctccgcagcaatggcagaaaatgccgttctggaaaaaagtgcgtccgtgggcggcgcagcttacccaaatgggcgtggcggcgtgcgtttcacttgcagttatcgtcggtgtccagcactataatgggcaatctgaaacatcccaacaacctgaaacgccggttttcaataccctgcctatgatggggaaagccagcccggtaagtctgggagtgccttctgaagcagcgcctgtcggcagtcagcaacagcaggtacaggagcagcgtcgtcgcattaatgccatgttgcaggactatgaactgcagcgccgactgcactccgaacagcttcagtttgagcaggcgcaaacccagcaagccgcggtacaggtgccaggaatccaaactttaggaacgcaatcgcagtaatgaagcaactttggtttgccatgtcccttgtggcggctagcctgttcttctcagtaaacgcctcggccgaccctgcgtccggggcgttattgcagcagatgaacatcgccagtcagtcactgaattacgagctgtcattcgtcagcatcacgaaacaaggcgttgaatctctgcgttatcgacacgcacgcctggatagtcgcccgcttgcgcaattgctacagttggacggtccccgccgggaggtcgtacagcgtggtaatgaaatcagttattttgaaccgggccttgagccgttcaccctgaacggtgattatattgtcgattctctgccttccctgatttacaccgatttcaagcgtctggcgccttactacgactttatttccgtcggacgcacccgtatcgcagacagattatgcgaagttatccgcgttgtggcgcgcgatggtacgcgttacagctatatcgtctggatggacatggacaccaaactaccgatgcgcgttgatctgctggatcgcgacggcgagacgctggagcagttccgcgttattgcgttcacggtgagtcaggatatcggcagcaccatgcaggcgctggcgaaggcgaatctgccgccgctgctttctgttcccggtggcgaaaaaacgaaatttaactggaatccatcctgggtgccgcaaggctttagcgaagtttccagcagccgtcgtccgttgccgacgatggataacctgcctatcgaatcgcggctttattctgacggtctgtttagcttttccgtcaatgtgaaccgggcgacgcaaaacagcagcgatcagatgctgcgcaccgggcgccgaacggtttatagcagcgttcgcgacaacgcggaaatcaccattgtcggagagcttccgccgcaaacggcgaagcgcattgccgacagtatcaaattcagggcagtacaatgattaaagagtgggcaaccgttatctcctggcagaatggtcaggcggtggtgagctgcgacgttaaagcgtcatgcagcagctgcgcctcccgtgcgggatgcggcagtcgcgtgctgaataaattagggccgcaaaccacgcataccattgttgtgccaagcgcggagccgctggctccggggcagaaagtcgagttgggcatcgccgaaaaaagccttttaggttcggcgttgctggtctatatgtcgcctttagcggggctatttctttgtgcggcgctttttcagatgctgtttggatctgaccttgccgcattaagcggggccgtgctgggcggagtgggcggttttctggttgcccgcggctattcccgaaaactggcggagcgcgacgcctggcagcccgtgattttaaacgttgccctcccgcctgaccttgtccgcgtcgaaactacctcaatcgaaacgcgccagtaaacgttttgcccaatggtacatggtacacctgccgcgttgggttgttgtcccgataagcatgcgcttttcctgcgttgcggtgttttacaggaaaaaagcgaggcgttttccagttcccgctctccttacactatgaacatttcctcgccttagcgttgtagtgtagaatgcggcgtttcagttaaaacagacgttaagctcagaacagcgacctctaaagtctggtcaaccaggcgtaaggcataataatttatctctatgaagaacatacgtaacttttcgatcattgctcacattgaccacggtaaatcgacgctgtctgaccgtattatccaaatctgcggtggcctgtctgaccgtgaaatggaagctcaggtacttgattcgatggatcttgagcgtgagcgcggtattactattaaagcccagagtgtgacgctggattttaaagcgtctgatggtgaaacttatcaactgaactttatcgacacgccgggacacgttgacttttcctatgaagtttcccgttcgttagccgcctgcgagggcgcgctgctggtggtggatgccggccagggcgtagaagcgcaaacgttggcgaactgctacaccgcgatggaaatggatcttgaagtggtgccggtgcttaacaagattgacctgccggccgccgatccggagcgtgtggcggaagaaatcgaagacattgtcggcatcgatgcgacggacgcggtacgctgctccgccaaaacgggtgtcggcgtgacggacgttctggaacgcctggtgcgcgatatcccgccgccgcaaggcgatccggacggcccgctgcaggcgctgattattgactcctggttcgataactacctgggcgtggtatccctggtgcgtattaaaaacggcaccatgcgtaaaggcgacaaaattaaagtgatgagcaccgggcagacctacaacgctgaccgcctggggatcttcacgccgaaacaggttgatcgtaccgagctgaagtgcggcgaagtaggctggctggtctgcgccattaaagatatcctcggcgcgccggttggcgataccttaacctcagcgcgtaacccagctgaaaaagcgttgccgggctttaagaaggtgaaaccgcaggtctatgcaggtctgttcccggtcagctccgacgattatgaaagtttccgcgacgcgctcggcaagctgagcctgaacgatgcctcactgttttatgaaccggaaagctcctcggcgctgggctttggtttccgctgcggcttcctcggcctgttgcacatggagatcattcaggagcgtctggaacgcgaatacgatctggatctgatcaccactgcgccgaccgtggtttatgaagtagaaacaacggcgaaagagactatctatgttgatagcccctccaagctgccgccgttgaataacatttatgaactgcgcgagcctatcgccgaatgtcatatgctgttaccacaagcctatttaggtaacgttattacgctgtgtattgagaaacgcggcgtacaaactaacatggtgtatcacggtaaccaggttgcgttgacctatgaaatcccgatggcggaagtggtgctcgacttctttgaccgtctgaaatcaacgtcgcgcggctatgcgtctctggattataacttcaagcgcttccaggcttccgatatggtgcgtgttgatgtgttaatcaacaacgagcgtgtcgatgcgctggcgctgatcacgcaccgtgataactcgcaaagccgtggtcgcgagctggtggagaaaatgaaagatttgattccacgccagcagtttgatatcgcgattcaggcggcgattggtacgcatattattgcccgttcgacggtaaaacagttacgtaaaaacgtgctggcgaagtgctacggcggcgatatcagtcgtaagaaaaaactgctgcagaaacagaaagaaggtaagaaacgcatgaagcagatcggtaacgtcgagctgcctcaggaggcgttcctcgccattctgcatgtcggtaaagacaataaataatccctaaggagttggcatggcgaacatgtttgccctgattctggtgatagccacactggtgacgggcattttatggtgcgttgataagtttgttttcgcgccaaaacgtcgggcgcgccaggctgccgcgcaaacggcgtcgggagatgcgctggataacgctacgctcaataaagtggcgcctaagccgggctggctggagaccggggcgtcggttttcccggttctggcgatcgttctgatcgttcgttcatttctttatgaaccctttcagatcccgtcaggctcaatgatgccgacactgcttatcggcgattttattctggtggaaaaatttgcctacggcattaaagatccgatctaccagaaaaccctgattgaaaccggtcatccaaagcgcggggatattgtggtatttaaatatccggaagatcctaagttagattacatcaaacgcgccgtcggtttgccgggcgataaaatcacttatgatccggttgcgaaagaggtgacgattcagcctggctgtagctccggtcaggcgtgcgaaaatgcgctgccggttacctactctaacgttgagccgagcgattttgtacagacctttgcccgccgtaacggcggagaagcgaccagcggtttctttgaggttccgctaaacgagacaaaagaaaacggcattcgcctgaccgaacgtaaagagacgttaggcgatgtgacccaccgcatcctgatggtgccgatagcccaggatcagttgggcatgtattaccaacagccaggacaaccgctggcgacctgggttgtaccgccggggcaatatttcatgatgggcgacaaccgcgataacagcgcggatagtcgttactggggatttgttccggaagcgaatctggtcggtaaagcggtcgctatctggatgagctttgacaagcaggaaggggagtggccgacaggcgtacgcctgagtcgtatcggcggtattcactaactgtggcgaaatgatcgttcacgctgtcgtctttttagcggcagcgtgaattatttcctggataaattccctcagactaacgacatcccctgtcgttgtgtatagaatattcccccgaagttttaggttggcgccgtttggtcgccacggcacacgaaacagcgttggttatagacaaccttctttccgctgcagcgatgcggcaggacagatgacgtgtatcaggtctgtttcgtgtgctggattgttgacgcattcatttattggtatcgcatgaaccccatcgtaattaatcggcttcaacggaagctgggctacacttttaatcatcaggagctgttgcagcaggcattaactcaccgcagcgccagcagtaaacataacgaacgcctggagtttttaggcgattcaatcctgagcttcgttatcgctaacgcgctttatcaccgttttccacgggtggatgagggagatatgagccgtatgcgcgccacgttggtacgtggtaatacgctggcggaattagcccgtgaatttgatttaggcgagtgcctgcgtttagggccgggcgaattaaaaagcggcggatttcgtcgggagtccattctggcggacaccgtggaagcgttaatcggcggagtatttctcgatagcaatatccagaccgtcgagcagttaatccttaactggtataaaacccgtctggatgagataagtccgggcgataaacaaaaagatcctaaaacgcgcttgcaggagtatttgcagggtcgccatctgccgctgccatcttacctggttgtgcaggtacgcggcgaggcgcacgatcaggaatttactatccactgccaggtcagcggcctgagcgaaccggtggttggcacgggttccagccgtcgtaaggcggagcaggctgccgccgaacaggcgctgaaaaaactggagttggaatgagcaccgacaaaacttactgcggatttattgccatcgtcggacgtccgaacgttggcaaatccaccttgctgaacaaactgctcgggcagaagatttcgatcacttcccgtaaagcgcagaccacgcgccaccgcattgtcggtattcataccgaaggcccgtatcaggcaatctatgtcgataccccgggactgcatatggaagaaaagcgcgccattaaccgtttgatgaataaggcggcgagcagttcgattggcgacgttgagctggtgattttcgttgtagaaggcacccgttggacgccggacgacgaaatggtcctgaacaaactgcgcgatggcaaagcgccggttattctcgccgttaacaaggtggataacgtgcaggaaaaagccgatttgctgccgcacctccagttcctggcaagccagatgaactttcttgatatcgtccccatctctgctgaaacgggtatgaacgtcgataccattgccagtatcgtgcgtaaacatttaccggaagcgattcaccacttcccggaagattatatcaccgatcgctctcagcgctttatggcgtctgaaatcattcgtgaaaagctgatgcgttttctcggcgccgagctgccgtattccgttaccgttgagattgaacgttttgttaccaacgaacgcggcggctatgatatcaacgggctgatcctcgtcgagcgcgaagggcagaagaagatggtgattggcaacaaaggcgccaaaatcaaaaccattggtattgaagcgcgtaaagacatgcaggagatgtttgaagcgccggtacacctggaactgtgggtgaaagtgaaatccggctgggccgatgacgaacgcgctctgcgcagtctcggttacgtagacgatctgtgagttaacacagcgtggaagggtggcagcgcgcatttgtcctgcacagtcgcccctggagcgaaaccagcctgatgctggacgtcttcacggaagaatcggggcgcgtgcgccttgtcgccaaaggcgcgcgatctaaacgttccaatctgaaaggcgcgttgcagccttttacgccgttattgctacgctacagcggacgcggcgaggtgaaaaccctgcgcagcgccgaggcagtttctctggcgctgccgttaagcggtattacgctctatagcggcctgtatatcaacgaactcctctctcgcgtactggaatatgaaacgcgcttctccgaactcttttttgattatctgaactgtattcaggcgctggcgggaaccaccggctcgcctgaaccggcgttgcgacgtttcgaactggcgttgctgggacatctggggtatggcgtcaatttcacccactgtgcaggcagcggcgaacgggtggatgacaccatgacctaccgttaccgcgaagaaaaaggctttttcgccagcgtcgtcatcgataacaacacctttaccggacggcacctgaaagcgctggaggcgcgggaatttccggatgtagataccctgcgtgccgctaaacgctttacccgtatggcattaaagccgtatcttgggggaaaaccgttaaaaagccgggagctgttccggcaatttatgcccaaacgcacagtaaaaacgaagaaagattaacgaggattgtcatggctgaattactgttaggcgtcaatattgaccacattgccacgttacgtaatgcgcgcggcaccgactatccggatccggtacaggcggcgtttattgctgaacaggcaggcgcggacggcattaccgtacacctgcgcgaagatcgtcgccacattaccgatcgcgatgtgcgcattctgcgtcagacgctgcatacgcgtatgaatctggagatggcggtgaccgaagagatgctggcgatcgccgtagaaaccaggccgcatttctgttgtctggtgccggaaaaacgccaggaagtcaccaccgaaggcggcctggatgtggccggacagcgcgataaaatgcgtgatgcctgtgcgcgcctagcggcggctggcatccaggtttcgctctttatcgatgccgatgaaaggcaaatcaacgcggcggcggaagtcggcgcgccgtttatcgaaatccataccggctgctatgccaacgcagaaaccgatgcggaacaggcaaaagagctggcgcgtattgccagcgccgcgaccctggcggcccgtctggggctaaaagtaaatgcgggtcatggcctgacctaccataacgtcaaagctattgccgcactgccggaaatgcacgagctcaatatcggtcatgccattattggtcgggcggtgatgacggggctgaaagaggcggtggctgaaatgaaacgtttgatgctggaagcgcgcggctaatggcgattctcggcctgggaacggatattgtagagattgcccgcattgaggcagtgatctcccgttccggcgaacgtctggcaaggcgtgtgctcagtgacaacgagtgggctatctgggagacgcatcagcagccggtgcgttttctcgccaagcgttttgcggtcaaagaggcggcagcgaaagcttttggcaccggcatccgcaacggtctggcgtttaatcagttcgaagtgtttaacgatgagctgggaaaaccacgtttgcggctgtggggcgaggcgttaacgctggcggaaaaactcggtgtggcgcacatgcatgtcacgttggccgatgaacgccattacgcctgcgctacggtcattctggaaagttagatttgccggatggcggcgtaaacacgttatctgacctacaggccgatatattgccggcctgataagcacagcgccatcaggcattgttgcgttggaagtgcgttaacccgcttacaatttatctgcgtgatgcatcagaacaaacttatcccacaactgttcttcggtttcgacatgggcgggatcctgcaaaatcgtattggggatcgggcagactttctgacaggtcggcgtttcgtaatggcctacacactcggtgcatttgtcgctgttaatctcataaatgctgtcgcccattgaaatcgcctcattcgggcactccggctcgcacatatcgcaattgatacattttttggtgattaacagcgccatcaggaaattctcagaaacaacacaaatcgggcgggcattatacgcctattttctactcgggccagctcttttctggcgctgatttgttatctacagtgtaaaaatttttgatctgcttgagcaggcagatggttgcgttatccagtgaaaggtcattactgtgcaccagcatgacaggaataaagaatgcggggatgcccagtgaaaccaggcgaacatttttgggtgtcgataaatgggttagcgagcgggtaataaatgcgatgccaatctgcgcttcggcatactcaaggcatgagtagtggttatccagttcgcagatgacgttaggaacgactttgcggttattaaattctgtggtgatgatccctcttaatagcagagagtcattaagcacgataatgggctggtcgtttaaatcttttagatgcagacgttcgcgtgtcgccagaggatgagaaagtgggattgcagcgataatttcatcttcaaacagcatggtcgagcttagctgggcagggagcgctgttcgataaacaatgccaatatcaacggcgctatccgtcagctttttaatggtttgctcagttgagaactctttaacatttaaagatatttccggatggtgcgccataaagttgcgaaaagcgggcaggaccaggtagctgcctgacaccccgattgaaatagtatcgcgctgttgatcctgatagggaagaagttcattttcggcattttttaaatccagcattattttgttagcgtgtcgttgcaaaataatgcctgcttttgttaatttaattcctctgccttttcgcttaaataatattgttttaagtgatgactcaagttgtttgatttgctgacttaatgatggctgagtgataaataggcgactggctgcccgaccataatgtaattcatcacacaatatcaggaaggagtgtagttgtttgatattcattaaaatttaatgccaatcgattgggttttgttataacgattataaaaaataccaaattgtttgcctattttgctttttttaaactgtgatcagtgcattttaaaaagggaaaattatgtcggcatcaatcaaccgctggggaatgcttgccgctcacgtgtgcatcaattttgtgctcgggggcgtctacgcatttagctatttcaaaacaccactcatggcgcaatatcactgggatccggctacgccggcgttagcattctctatcaatatggggatcattcctttaccgatgatttggggcgggagaatgatcgacaatggtaaaggaaagcaggcgatagttatcggcggtatcctgttttctttaggttttatcttgtccgggtttgtggataatttgcccatgctgtttttaacctacggcgtcattgccgggttgggatcgggcctggcttttacgggtaatcttaataatattctgaaatttttccctgaccgtcgcggtcttgccagcggtatcgtactggcgggtgttggcgtcgggacgctactttgcacccgcctggccgaatattttatggcgcaaactcacgatgttagtcgggcgttgttatatctgggtattgtttatctggtggttatttttatcgtccagttctttattcgtagcgcgccagcaaaagatagcggaggaattaaagcctcgccactggataaagactatcggcacatgctgaaagatctgcgcttctggctgctgtttatgattctggcgctgggcgtgttctctgggatggtaattagctcaagttctgcgcaaattggtatgacgcagtacggtttactgtccggtgcattagtcgttagcctggtctcgatatttaactcgatcggtcgcctgttctggggagggttaaccgataaattaggcggctataatacgctggttattgtttatctttttacctgcgtctgtatgctgctgctgttgttcttcaacggtaatacttcggtattctatttcagcgctctgggcgtgggctttgcttatgccggtatattagttatcttccttggcttgaccagccagaattttggtatgcgtaaccagggactaaactacggctttatgtattttggttttgccgtcggtgcggttattgctccttacgtcacgtccgctattgcaaaatataccggaagctacaatacagtatttattttgacaacggtgctattgcttattggagtcgtgttgaccctgataacgaaaaaatatgtcgcaacggttttagccaaaattcattaatcagataataaggaaataaaaatgaaaattgcaatcgcaggtgcaggcgctatgggatgtcgttttggctatatgctgctggaggccgggcacgacgtgacgcttattgatggctggcaggagcatgtcgacgctattcgtagcaaggggttgtttgtcgaaacggaaacgactcagaagtattaccccatccctgctatgttggctgatgaatcccagggggagtttgagctggttattctgtttaccaaagccatgcagttggatagcatgttacagcgtattaagccgctgctgccagccgcgaaggtcgtgatgattttatctaacggcctgggaaatatcgaaaccctggagaaatatgtcgatcggcagaaaatctatgcgggtgtgacgttatggtccagcgaactggagggggctgggcatattatggccaccggtaccggaacgattgaactgcagccgatagccagccaagattcggctcaagaggctaaggtcattgccacccttaatagtgctggattgaatgctgaaataagccctgacgtattattatcgatctggaagaaagcagcctttaatagcgtaatgaacacctattgcgcgttactggattgtaatgtcggcggatttggtcagcggcctggtgctttagatttagcgcaagcggtagttgatgagtttgtgttagttgctgccagccagaatattccgttgactgagcaaatggtgatgaatacggtgaagaaagtgttcgatccgcgtgagagcggccaccactatccttctatgcatcaggatttacataaaggccgactgaccgaaatcgactatttaaatggtgcgattgcgcgaatcggcgctcagaacaatattgccgtaccggttaacacactcctgacgcaattgattcacgctaaagaagcgcaataaacttgatagctcttctgcatgaggcggaagagccattttcaaaccagtttttttaccagcgcctcgctatggcgaatacgctccggcgcccgctctaaatcctgttgtaccagcgccataaacagtaagtcggtcaacatcatttgcgcatgtgtcgaggagatagcggcgctacgcgtcgcctgctcttcggcaatcgtatacagacagcgggtggcgcgctgctgcaaggcgttgggagaaaaaccggtaatggccaggattttcgcgcctgcgcgtaatgtttcgtccgccgccaggttcagctcgcgccgctccccggaataagagatcgccagcagcagatcctccggcgccagcgcctgcaccgtcgccagcagggcgtgcatatcgcgctcaaccaccgcgttaatgccaatcttcagtagcttccaggcaaaattttgcgccaccagcccagaggcgccaattccggtgatcacaatacggcgggcgtggcgcagcatcgtgacgctttctaacagcttttcttcactgttaacgtccagcgtggcgtgcatcgccgccacattctctttaattaatttttccccgaccaggcgcatcggatcgtcgccgcgaatctggttatgaacgggaacggaatgcggattaggattgctggccaacgcttcgctgatagccagtttcaacgccggaaaccctttaaaccccagtttttgcgcgaacttgactacgctggattggctgacgcccgcttcggccgccagttgctgcgagctcagatgtcgcgccgtatccggttgcgcgagcagataatccgccagtttcctgtcgctttgcgcgagatccggataacgctggcgaatacgaatcaaacagttcatgggcagctcctgcgaaacgtgatggcgacgacaaaacgaaatttcactcgcctgggggaatattctattccatcatggacgcttattatgaattaaaaattccagagggacaaaaatgaatcttggtaccttagtgtctgaaacccgtaacccgcaaacgatggatctggatgcgttgtctactcctgaattagttaagcgttttaatgaacaggatacgctggtagcggaagcagtaaaagccactctgcctgacgttgcgcgtgcggtggatgctgctgcggcggcgctgaagtctggcggacgtatcatctatatgggggcgggcaccagtggtcggcttggcgtactggatgcctcagaatgccccccgacgtttggcgttccgcacggtctggtcgtcgggctgattgccggcgggccgggcgcgttgctgaaggcggtcgaaggcgcggaagacagccaacaggcaggcgaagacgatcttgtcgcgctaaatctgcaagaacaggatctggtcgtggggctcgcggcgtcgggtcgtacaccctatgtgattggtggcctgcgctatgcgcgacagtccggttgtaccactgttgccgtctcctgtaatccagattcgcctattgcgcgggaggctaatatcgctatttcgcccgttgtcgggccggaagcgcttaccggctccacgcggctgaaatccggcaccgcgcagaaaatggtgctcaatatgatttctaccggcgcgatggtgaagttcggtaaggtctatcagaacctgatggtggatatgaaagccaccaacgtcaaactggtcgatcgcgcgtgtcggatggtcgttgaagcgaccgggataggtcgtgaagaggcggaaacgttgctgaaacagaccgattttgaggttaagcccgccattttgatggcgcttacggggctggatgctgcagccgccagggaaaaactcgccgctcatcagggctttttaagggcggcgttagaacactaaagaggtgtgtatggataagacggcagcgctcgccagcgacattttacgtggtatcggcggagagcaaaatattctgcgcctggaaaactgtatgacgcgagtcagagtggaggtacaggacgacagccaactggatattccgcgcttaaaagcgttgcctggcgtcagtggatacgtaaagcaaggggagcaacatcagctgatcgttgggccggggaaggctgcacaggtggttgatgcgatgcgcgtgcagattgccgcaggtggtgtaaagccggacgatgctatggcgcgtaccaaatccgaggcgaaagcgaagtataaagcgccgatgagcgatgcgttgcgtaagctggcgaatgtttttattccgcttattcccgcctttatcgcatccggcttgattaccggcattatcaatattcttaaacgcccggatatcgtcggcgatgttgccgtccactatcctaacctgctgggcctgatggggatatttggtagcgcggtgttcgctatcatgaacattctggttggcgtcaataccgcgaaagtctttggcggatcgcaggcgttaggcggcgtgatggcggggatcctttccagcccgcaactggcgcagattacgctctttggcgaggcgcttcagccgggacggggcggcgttatcgccgtcctgctggtggtggcgttaatgtgctggattgagcgccagttccgtaagctgctgccggggtcgctggagttaattcttaaccctttattgacgactgttatcaccggcgcggtagcgattgtcgctctgcaaccgcttggcggctggatttcagacgctatcgctcacggcgcgtcctgggctatcgatcgcggcggttttctggtgggcgcggtgttagccggaaccttcctgccgttggtactgatcgggctgcatcaggggctggtgcctattcatgtggagctggtgcaagcgcacggctataacgcgctgtttcccatcctggcgatggcgggggttggtcagataggcgcggccattgccgtactgatgaaaacccgcaatgcgcggctcaaaaaggtgattaaaggcgcgcttccggtcggactgctggggattggcgagccgctgatttttggcgtcacgctgccattgggtaagccatttattggcgcttgcctcggcggcgcggtaggcggggcgttgatcagctactggaaagtggcgacggtaattacctttggtatttccggtttgccgctggcattaacaattgttgccggaaaagtcctgttctatctgttaggctatttaatagcggtaattgccgggtttatttttacctggctgctggggttcaatgatccagaggagtaaggtttggtcagccacgagcgtcgtgtcgtcttttttgatttggatggaacgttatatcaacaggatatgttcggcagttttctgcgttatttgctgcgccgtcagccgctaaatgcgctgctcgtactgccgttgttgcccattatcggtatcggtttactggtaaaagggcgtgcggcccgctggccgatgagtctgttattgtggggctgtacttttggccatagcgaaacgcgtttgcaggcgcatcaggcggattttgtccgttggtttcgcgctaacgtcacggcgtttccggtcgtacaggagcgtctgaccacctatctattgagctctgacgcggatatctggcttattaccggttctccgcaatcattggtagagcaagtctattttgatacgccgtggttgccgcgtgttaacctcatcgccagccagatggcgcgacggtatggcggctgggtattaaccgtgcgctgtctgggccatgaaaaagtcgcgcaactggaacgtaaaatcggtacgccgttgcgtctttatagcggctacagcgacagcaaacaggataacccgctgctttatttttgccagcatcgctggcgggtgacgccgcacggcgagttgcagcagctcgaatagtgaaacgcatagcgtctgtgtataatgccgcccgctttcattaccggagttacctctttgtctgatgtcgaattagatcacgaatactggatgcgccacgcgctgacgctggcgaaacgcgcctgggacgaacgcgaggttccggttggcgcggtattggtgcataaccatcgcgtcattggcgaaggctggaatcgacccattggccgccacgatcctactgcgcatgctgaaataatggcgctgcgtcagggcggtctggtattgcagaattatcggttactggataccacgctgtatgtcacgctggaaccctgtgtgatgtgcgcaggcgctatggtgcatagccgcattggacgcgttgtctttggcgcgcgcgatgcaaaaactggcgcggccggatcgctaattgacgtgctgcaccatccgggaatgaatcaccgggtcgagattattgaaggggtgttgcgcgatgaatgtgcgacgctgctcagtgattttttccgtatgcgtcgtcaggaaattaaagctctgaagaaagccgaccgtgcggaaggcgcggggccggcagtatagcgcaatgccggataagacgttgcgcgtcgccatccgataagaccatcgcgctatttttcttctttcttctgcggcgtaaacagtaaagacggcgaatgcgtcaggtagcctgatgactgcgataaaaacgacaggaaggggaagggggctttattcagctcctccggctacaccgccgggtaatcctgcgccagtttcatagcttccgcttcctgcttttctttttcctgcaaataccccaccaaacttatctggtatttacggatattttccacataagcataagcctcatgtccacgcgcgtaaccgtaggttagcttactgtaatacggtttttggcttaacagaggcaaacgctgcttcacatcggtccagctatccggattgcctttggtttttaccgtcagcgatctggcatcgagcatgtgcgcataacccatattgtaggcggctaaggcaaaccagatacgctcgtcttccggaacggtttcgggaactttagccatcatatcttcaagatagcgagcaccgccgctgatgctttgctccgcatcggtacggtcggtcagccccagactttgggcggtatttttagtcagcatcatcaggccgcgcacgccggttggcgaggtcgccagcgggtcccagtgtgattcctgataagaaatcgccgccagcaggcgccagtctatctctttggcatattttttaaataacggttccagctccggcaggacgttatccaccgctcgcaggaaagagcgggtatcaacgtagtcgaaatcatcgccatgccccagatatttctcttcgatccgcgccaacgacccgtcttcattgatcgaattgaaaaaatcgagcagcgcggcggagagcgtattatcgtcgtccagtcggctaaaccaggtcacgggctgttcatccgtgacatccagcgccacggccagttcgggatggacgcgctgaaacagactgatcgccactgaatcggcaatggtgtaatccagtttgccgctgatgacctcttccagcagcgtcgtcgagccttttttatcatccaccttccagctcaggtcgggaaactttgtctcttttaaacgctgtaaatcattgaccacgacgtgccctggcgcaatggtaagctgattctcgttaacggtcgccagcgaacgtgggcgatattgtccgacccggtaaacgagctgttgcgaaaccgaataatacatggggccgggctgatagtttttaacgcgcgcgctgtcgtagaccagccctgccgcgagcaggtcggcattgccgttatccagatcgtcaaacaactggctgatattctggcgcaccgtcactttcagcttcacgccgagatagttggcgaactgctgcgccagttcatagtccagaccatattttttaccgttgataacggaataggttaatggcgagtcgatcgtactgacgcgcagtaccccccgggcttgaatcgcggcgatatggttttcggttttaccgaaccaggggattgagggccaaagggctgctgccagcagcagcgtcaatatgccgatgaacagataattaatctttaattttttcaattagttaattctctggatcgtgcgttgcctcgggctgaaaaagatgttttgctgcaatagataagtcactaatgagcggcattttgcgtaacaatgcgccagttggcaacttattcgcaacgatagccgcaccgtatgacaagaaaaagcggtgattttatttctacgcaaacggtttcgtcggcgcgtcagattctttataatggcggccgtttccccccttgcgcacaccgaagcttagaagacgagagacttatgatggaaattctgcgtggttcgcctgcactgtctgcattccgtatcaataaactgctggcgcgctttcaggctgccaacctccaggtccacaatatatacgctgagtatgtccattttgctgacctgaacgccccgttaaatgatagcgagcaggcgcagcttacccgtctgctgcaatacggcccggcgcttagcagccatacgctggcgggtaaactcctgttggtcacaccgcgtcctggtaccatctccccctggtcttcaaaagcaacggatatcgcccacaactgcggcctgcaacagattgaccgtctggagcgcggcgtagcgtactatatcgaggcttcgacgttgacggcggaacagtggcgacaagtggccgcagagctgcacgaccgtatgatggagacggtgttctcttctttaaccgatgcggaaaaactgtttatccaccatcagcctgcgccggtttccagtgtcgatctgctgggagaaggccgtcaggcgttaattgacgctaacctgcgtctcggtctggcgctggcggaagatgaaatcgactatttgcaggaggcgtttaccaaactgggatgcaacccgaacgatatcgaactgtacatgttcgcccaggcgaactccgagcactgccgccacaagatttttaacgccgactggattatcgacggtaaaccgcagccgaagtcgctgtttaaaatgattaaaaacaccttcgaaaccacgccggactatgtgctctctgcctataaagacaatgccgcggtgatggaaggatctgcggtggggcgctacttcgccgaccacaataccggccgttacgattttcatcaggagcccgcgcacattctgatgaaggtcgaaacgcataaccacccaaccgccatctctccgtggccgggggcggcgaccggttccggcggcgaaattcgtgatgaaggcgccaccgggcgtggcgcgaaaccaaaagccgggctggtaggcttctccgtttccaacctgcgtattccgggctttgaacagccgtgggaagaggattttggcaagccggaacgtattgtcaccgcgctggatatcatgaccgaaggtccgctgggcggcgcggcgtttaacaacgaatttggtcgcccggcgctgaccggttacttccgtacttatgaagagaaagtgaacagccacaatggcgaagagctgcgtggctatcacaagccgatcatgctggcgggcgggatcggtaatatccgcgccgatcacgtgcagaaaggcgagatcgtcgtaggcgcgaagctgatcgtccttggcggcccggcgatgaatatcggcctcggcggcggcgcggcatcgtcaatggcttccggccagtctgatgcggatctcgattttgcctctgttcagcgcgacaacccggaaatggaacgccgctgccaggaagtgatcgaccgctgctggcagttgggcgacgctaacccaatcctgtttatccatgatgtgggcgcgggcggtctctccaacgccatgccggagctggtaagcgacggcgggcgcggcgggaaattcgaactgcgcgacattcttagcgacgagccgggcatgagcccgctggaaatctggtgtaacgaatcccaggagcgctatgtgctggcggtcgcggctgaccagttaccgctgttcgatgaactgtgtaagcgcgaacgcgcgccgtatgcggtcattggcgacgctaccgaagaacagcatctctcgttgcatgataaccatttcgacaatcagccgatcgatctaccgctggatgtcctgctgggcaaaacaccgaaaatgacccgcgatgtgcaaacattgaaggcgaaaggcgatgcgctgaaccgcgcggatatcacgattgccgacgcggtaaatcgtgttctgcatctgccgaccgtggcggaaaaaaccttccttgtcactattggcgaccgtaccgtcaccggtatggtggcgcgtgaccagatggttggcccgtggcaggtcccggtagctgactgcgcggtcactaccgctagcctcgacagctactacggcgaagcgatgtcgattggcgagcgcgcgccggtggcgctgctggactttgccgcctccgcccgtctggccgtcggtgaagcgttgactaacattgccgcgacgcagattggcgatatcaagcgcattaagctttccgctaactggatggcggcagccggtcatcctggcgaagatgccggtttgtatgacgcggttaaagcggtgggagaggaactctgtccgcagcttggcctgacgattccggtgggtaaagattcgatgtcgatgaaaacccgctggcaggaaggcaacgaacagcgcgaaatgacctcgccgctgtcgctggtgatttccgcgtttgcccgcgtggaagacgtgcgtcacacccttacgccgcagctgtcaacggaagataacgccttgctgctgatcgatcttggcaagggccacaacgcgctgggcgcaacggcgttggcgcaggtctatcgtcagcttggcgacaaacccgcggacgtgcgtgacgttgcgcaactgaaaggcttctatgacgccatgcaggtgctggttgctgcgcgtaaattactggcatggcacgaccgttccgacggcggtctgctggtgacgctggccgagatggcctttgccggccactgcggcgtgcaggtcgatatcgccgcgctgggcgatgaccatctggccgcactgttcaacgaggagctgggcggcgtgattcaggtacgcgctgaagacagagacgcggtcgaaacgctgttggcgcagtacggtcttgctgactgcgtccactaccttggtcaggccctggctggcgatcgctttgtgattaccgctaatgatcggacggtattcagcgaaagccgtactacgctgcgtgtctggtgggcggaaaccacctggcagatgcagcgtctgcgcgacaatccgcaatgtgctgaccaggaacacgaggcgaaagcgaatgatgccgatccgggcctcaacgtgaagctgtcgtttgatattaatgaagatatcgccgcgccgtacattgcgacaggcgcacgaccgaaagtcgctgtactgcgcgagcagggggtgaactctcacgtggagatggcggcggcgttccatcgtgcgggctttgacgcgattgacgtccatatgagcgacctgctgggcggtcgtatcggtctgggcaacttccatgcgctggtggcttgcggcggcttttcctacggcgacgtgctgggggcgggcgaaggctgggcgaaatccattctgtttaaccatcgggtgcgcgacgaattcgaaaccttcttccatcgtccgcagacgctggcgctgggcgtgtgcaacggttgccagatgatgtcgaatctgcgcgagctgatcccgggcagcgaactgtggccgcgttttgtacgtaaccattctgaccgcttcgaagcccgcttcagcctggtggaagtgacgcaaagcccatcgctgctgctgcaaggaatggtaggctcacagatgccgattgcggtttcccatggggaagggcgcgttgaggtgcgtgacgatgcgcatcttgccgcgcttgagagcaaaggcctggtcgctctgcgctacgttgataactttggtaaggtgaccgaaacctatccggctaacccgaacggttcgccgaacggcatcacggcggtgacgaccgaaaacggtcgggtgacgattatgatgccgcatccggaacgcgtattccgcaccgtcgccaactcctggcacccggaaaactggggcgaggatagcccgtggatgcgtatcttccgtaatgcgcgtaagcagcttggttaattagcccgatagccattaagcccctcttcacgaggggcttttttgtagacggcgcttatcaggcccacggggaagcgcggttgtagctaccgtcttgaacgtcaagcggtagggcggataaggcgtttacgccgccatccggcaataaactagcgcttatgccgcaagattaaagtgtcgggaaatcccgacatgagtggggataggttgtcgccaaaaagagacatttaactatttgattttaaatgattttatttttaggtgttgcaggtgttgctgattgacgacagaaaggacaaaaaacagacagagccatttttagcatgaataacgatatttttcatatctatcattgtgttaacaaagtcttttgaatgttggcacaattactgcataatggtaaccagtggctcattcaccttcttatgtcagccccttagggacgcgctacataaacttcgaatgacgcacaacaaggtgcctgccgtctaacttctgataatagcgtagctttatcaacctccgggcgaaacgtcgagttaggcaccgccttattccataacaaagccgggtttagcccggctttgttgtatctgacgctcccctcggttagcatcttttttattcttctttttatgtgagcgacacgttgaagcgctggtctgttttcccccgttctttacgacaattggtcatgctggcctttttgctgatcctgctgccgttgctggttctggcctggcaggcgtggcaaagccttaacgcgttaagcgatcaggctgcggtgactaaccgcagcacgcttattgacgcccggcgcagcgaggcgatgaccaacgtcgcgctggagatggagcgaagctaccgacagtattgcgtgcttgacgatccgacgctggcaaaagtgtatcaaagccagcgtaagcgctatagcgatatgctggatgcccatgccggcgtcttgccggatgataagttgtatcaggcgttacgccaggatttaaacgcgctggcgcaattgcagtgtaaagatagcggcccggaagcggcagcggccgcgcgtctggaggcctttgccaacgcgaatacggaaatggtgcaggcgacgcgtactgtggtttactcgcgcgggcagcagttacaacaagaaatcgccgagcgcggacaatttttcggctggcaggcgctggtgctatttctggtgagcctggcgatggtgctactttttacccgcatgattatcgggccggtgaaaggaattgaacggatgattaatcgcctgggcgaaggccgttctttggggaataccgtcacctttaccggtccgcgtgaattacgatcggtggggcagcgcattatctggctgagtgagcgtctggcgtggctggaatcccaacgccatcagtttctacgtcacttgtcccatgagctgaaaactccgctggccagtatgcgcgaggggacagagctgctggccgatcaggtggttgggccgctgacgccggagcaaaaagaggtggtcgatattctggatgacagcagtcgtaatttacaaaaattgattgagcaattgcttgattacaaccggaaactggtagacagtgccacagagctggaagcggtcgatatcgcgccgcttgtggatatggtggtttccgcccacagtttgcctgcccgcgctaaaatgatgcataccgatgtcgacctggaggccgaacgctgcatagcagagcccatgttgctgatgagcgtgctggataatctctattccaacgctgtgcactatggcgctgaatccggtaacatttgtatccgtagtcgctctcagggctccacggtttatatcgatgtggttaatagcggcgaaccgattccgcaaaccgaaagagaaatgatttttgagccttttttccagggaagccaccagcgaaaaggggcggtaaaaggcagtgggttagggctgagtatcgccagagattgtattcgtcgaatgcagggagagatccagctggtggatgacaaagcgcaggaagtttgttttcgcatctcgctgccattgcctgcatctgacaaacactaatatgaatttaagcctggtgcgtatgtcacacgttttcgtccaaactattaaacgatgccttttgcgatggggaataccggtgggcatatcgtgtctggcgctgaccgcatgtgttccccatgcttcacagcaactgcccggtagcgcagcgcaggacacgctcccccattatcaactggcggattatctcccgacggcgtgcgcggatatctggtcgctacgcgggcaggcggtggagacgaatccgctgtactggctacgcacgattgactgcgccgatcgtctgatgccggttcagtcgcgcgcagaggcgcgcgcgttgacggatgataactggcagaatgccttcaggcgcgggattttactggcggatgcaaaaattacgccgccggagcggcgcgccatagtgacccgtctggaggcgttaagcgcgcaaataccggctcaggtacggcccgtctaccaaatctggcatgacggtcaggcgctgcaattagcgctttctgccgaacgtcagcgttatagcaaactccagcaaacgtcagatagtgagctggatgcgttgcgccagcagcaacaggccttgcaaacgcagctcgatcttactacccgtaagctggagagtttaaccgacattgagcgccagctttcgacacgaaaaccggcagggaattacaacgccgatacgccgcatacgaatgacaaacccgcgacgtctgaagatggcgcggcgccgtcgccgtcacaagatgaggtaacgccatgataagccgtaaaccggcgcacctgctgctggtcgatgacgatcccggattactgaaattgctcggtatgcgcctgaccagtgaaggatacagcgtcgtgaccgcagagagcggccaggaaggactacgggtactgcatcgggaaaaagtggatctggtaataagcgacctgcgcatggacgaaatggatggtatgcaactgttcacagaaattcagaaagtacagccgggaatgccggttattattctgacggcgcatggttctattccggatgcggtggccgctacccagaagggcgtattcagctttttgacgaagccgatcgacagagacgcgttatataaagcgatagatgaagcgctggagcagtccgctcccgcgacggacgatagctggcgcaacgctatcgttacccgtagcccgctgatgctgcgactgcttgaacaggcgcgcatggtcgcgcagtcggatgtcagcgtattgattaacggacaaagcggcaccgggaaagagattttcgcacaggcgattcataatgccagcccgcgcaataacaagccgtttgtcgccatcaactgcggcgcgttaccggaacagttgctggagtccgaattattcggccatgcgcgcggcgcctttaccggcgcagtgagcaatcgtgaagggttgttccaggcggcggaaggcggcacgctgtttctggatgaaattggcgatatgcccgcgccgttacaggtgaagctgctgcgggtgttacaggagcgcaaagtcaggccgctgggcagcaatcgcgatattgatatcgacgtgcgaattatttccgcgacgcaccgcgatctgccgaaggcgatggcgcggggcgaatttcgtgaagatttgtactaccggctgaatgtcgtgagcctgaaaattccggcgctggcggagcgtaccgaggatattccgctgctggctaatcatctgctcagacagtcggcacagcggcataaaccgtttgttcgcgccttttctactgatgcaatgaaacggctgatgacggcaagctggccgggcaacgtgcgccaactggtcaacgtcattgaacaatgtgtggcgttaacctcttcgccggtgatcagcgatgcattggtcgagcaggcgctggaaggcgaaaacaccgcgctgccaacttttgccgaagcgcgaaaccaatttgaactgaactatctgcgcaagttactgcaaattaccaaaggtaacgtgacgcacgcggcaaggatggcggggcgcaaccgcacggaattctataagctactctcccgtcacgaactggatgcgaatgatttcaaagagtagttttcatgccgtaaagtagcgcgaaatatgttacgtttaaccgatcaaaacacaggcgaccttttcaaggaatagcatgaaaaagattgatgcgattattaaacccttcaagctggacgatgtccgtgaagcgctggccgaggtaggtattaccggtatgacggtcactgaagtcaaaggctttggccgtcaaaaaggccacaccgagctgtatcgcggcgcggaatatatggtggattttctgccgaaggtaaaaattgaaatcgttgtgcctgacgacatcgtggatacctgtgttgataccatcattcgtaccgcgcagacggggaaaatcggcgacggtaagatctttgtctttgatgtcgcccgcgttattcgtatccgtactggcgaagaagacgacgcggctatctgatgtgccgattcgctgcccgtctcctccttgtgggcagcgaaccaccgtttaatcgccctgcggtagcgccgatgtagtccgggtgcaaatccatctcaggccgacaatggcgacgatcagcgccacgcaacttagtgtccactcgctcatttgcgagaaaaagtgtccgtaggcggctaccgccgtatcactaatttgcgattccgtggtttgttgcgcgacgacgccagccagccagttagcgatcgcgccggtcgccagcatataaataccggtcagtacgcccgtgacgccaggcagattgaggcgggtaatttgcgccatcgcgaccggatcaataaacagctccgcaaagcccatcagcgccagccctgcgatcatcattcccattgatgcctgcccatctaaccgggcctgatgcgcgtttagcgccagcagcataaaaccgccgcccattaatatcagccccacggcaaatttaagccagacgcgcagcaccgagcgggcgctctctttcgggctgctcagccacgccagcaccacgcccgccgccatcaccgcaatcgcattgaccgactggaacaatgcggtggggacggtcatattcagccagtggcggttgacaaaacggtcgatgaataaactgatcgaacttccgccctgctgcgccagaacccaaaagagagtgccggtgatcattaacagaacgatttgccacaaggcgcgacggtgttcgggaaatttaaccataatacgggcgataagttgcgccgcgaagacgcagacaatggccagcacatagccagaccagttattttccagcaggagggtgaagaataccggcgcgatacacagcattaataccagccaaccccaggttggaagggcgaatttaaccgcccgcagcgcggggcgattaacaccgcgcgtctgctgaaagtggcgatgaccgcttaaaaagatgagcaggccgatgaacattccgacgcccgccagcgcaaagccgacatgccagccataccactgcgccgccagaccacaggcgatcggcgcggctatcgatccaatattcccggcggcgtagagcagcgagaatcccccgtcgcggcggttgtcatcaggggcgtaaagttcgcccagcagacagctaatattggatttaaacaagccgtagccgcagataataatggccagcgccgcatataaactcagcgttgaatcagattctaagcccaataccacatgacccagcgtcatcaataaggcgccggtgataaccgccacgcggttgccaagcaggcggtcggcaagccagccgccaagaataggggtaacgtaaactaaagaggcgtaggcgctgaagaggttgatcgcgtggctgtcattaaaaccaagctggtgggtaagataaaggatgagtaaggcacgcatgccgtaaaagctgaagtattcccaaatttgaatcgccacgatgtaaaaaatcgcgcgcggttgtgagggtgttttcataaagtctccttgctgcgtgaaaaaagggaagtggcaagccacttccctttggtacttatttcgtattttctttcagcaccttaacggtgtaacgtccgtcagcctgacgataggcgccgtggatatcggtttcgaagcccggatagtgagcgccgatttcgcacagcatttgcaggaattccagtaccggacggctttcctcggtgatcatttcaccaggcatcaccagcggcactcccggagggtaaggaaggatcatgttggcgttgacgcgtccaaccatctcttcaagatacacctcttccgtttcgccatgcagctctttctggaacgcagtatacggcgtcatcaccattttcggcagcacttcaaacgcacggtacattaagtccggcagattatgatgttcgaccagtttatgaatattctgcgccagttcctggatgcgcatattttcataaaactcaggcgcttcgcgatacagtgccggcagaatgtttttgacgcgcaggttcaggtcaaaggcgcgtttaaattcagtgagcgcgcgcagcaggctcagagctttggttttgtcgataccaatgctgaacaggaacagcaggttgtatggaccggttttttctacgatgatgccgcgttcatcgagatatttggcgaccagacttgccggaataccgaattcatccatcgtaccgtctttcttcatccccggcgtcaggatagtgactttgatcgggtcgaggtacatgtgttcgttatcgatatttttgaagccatgccatgcgctatctgaacgcagcggccagcactcagctccatcgatatgttccggctgccatacgtcaaagaaccagccgtcagattcgcttttcaggcgtttaatttctttacggaatttaatcgcacgttcaatagagccgttaatcaggcgtttacccgcattacctttcatcatcgccgctgcggtttcagtagacgctacgataccgtagtgcggagaagtggtggtatgcatcatgtaggcttcgttaaaggtttcttcgttaatgtcgcctttaacatgaatcatggatgcctgtgaaaacgccgccagcagtttatgcgtggactgggtttcataaatgattttgccttctacacggtcgccgctcataccgcatttaccctgataaataggggagaaattggtgtaaggcacccaggcggagtcaaaatgaatggacttcacatccagagttttcttgatgtagtcagtgttatacaacagaccgtcataggttgagttagtaataacagcatggaccggccaggtggcgttaggcgtctcttttacccgtttagcgatagtggcgtgctggaactcgctttgcggaataccgccaagaataccgtaggcgttacgggttgggcggaaataaatcggcgtaatgtcgctcatcatcatcagatgggtcagcgatttatggcagttacggtcaatcagtaccgtgctgcctgccggcgcggagtacataccgacgattttgttcgccgtagaggtgccgttcgtcaccatgtagctacgttcggcgttaaagacgcgggcgatatactcttccgcttctttatgcgggccggagtggtccagcagcgaacccagttcggaaacggaaatcgaaatatcggatttcatcgtgttcgggccgaagaaatcataaaagatgctgccgacggggcttttctggaaagcagtaccgcccatgtggccaggcgtacagaaagtgtatttcccttcgcgcacatatttgaacagtgcttttgtcagcggcggcagaatattgtcgatgtattcatcggtattctggcgaattttcgccgcgatatcggctgcggcgcctaaagcatattcaaagaagcgaacctgcattctcagatcgttgaggctgacgtccagcgtagagtagctgttggcgaaggcatacagcggcatatactcgttcagcttgctaatctcttcgcaaagctcaaggttatatttatcccagtcgaaaatgacgccgcaaaggcgggagttattttcaatcagcttcagcaggtcttctcggtcgtttggatagacgatacggaaatttaaaccttccagtgcacgatgcagttcacgaataggctcttctttaaagtagacgcccatgtggttcatgatagcaataacgttcatagtcttgttcctggtaaagtgggcccctcccgctacgctatagcaggtgacgaaaggggctttgagaaaaaggagttagcggttaaagcgcttcagccgtattgttgtcgctgtcgttgttctggcgctggtgcattttgcgaccgtagaacatcaggatgatcagactgacgataaaggtgccggagagttcgaaggagctggcgcccatcagtgcgatgaagcaaaatgcgcagcccagtacagaacaaatcaggcttaccgagttacggatgttgaacccttcgaaacgaatcaggtcaacacaagagtagaagtacggcagcatggtaagcagtacggcaatcccggtcagttcgccgaacaggtcggacgctttaccgccgctggagttcatgatggtgatcagaatcatcagcgccgtcattttcaccgcagccaacagcagaccttttttcggaataccgtttttatccatttcaccgtaaattttcgggaagttgccgtcgttggcggcgcgaaccccagcctggccgaccagcatcatccaggagcccagagacgtcaggcaggcgaaagcggtaaaggcggaaaccagcggcgcagcccagccacccagaatcgtggaggtactgatagcgaacggcgcgccggaagaggccataacggaagctgggaacatcccggcgataacctgagtcgcggcgatatagatgatgcctgccagcgcggtacccagcatggttgccagcggtacggtgcgtttcgggtttttcaccatgccggtgctgacggcggcagactcaacgccaacgaacgcccacaggcagagcagaatacttttaacaatggcgtgagagtcggtcgtcgtagacgtgttccagttcgcgtgataggtcgcgatagcgaaccaatgccagccggcgactgcggtcaagactaccgggatcagcaccagaaacaggccaatcgttgtcaagcggctgacccaggccccgcccagcatattaataaaggtgaacagccagacgatagcaatacaggcaatacctgccggtattggattatttaatgccgggaagaacgtagaaagataagaaaccgcggtaataccgatggctaagttaccaatccagtttgcgtgataataaagaacgccggtctggaaaccaaacgccggagatatttccccagcataagcgatagggccaccctgttgcgggtttttggttgccagcctcgcataaacataagccagcgacattgccccaataatagaaattacccagccccagatggcaatgccaccaatactggcaaggttggcgggtaataatgcaatcccgctccccatcatattaccggcaacgacgccagtacaggcaaatagcccgatctttttgacagaactcatgttcatttctcctgagctgtatttttaagaaccgggcttatgcttcatatatgctgcgtgcccgttcaactgtcgacaagattaacgaatgggttgagataagtcctaaagaaaaagtgaaataaacacaaacatgaaaaaactgatagattgatttttttgaattaacatataaatatcatgaaaggataaatattgtttaattacaaagggttatatttacatttctttgcgatgaatatgttgccaaaattaacataagctattttttgcaacatatttttcacaaaataaaagcgaaaaatttaatatcttttcgcttttatttgtcatggttcagcgttaaatttaatcttctgccagaaaactattcagataagggacaattttctgaacggatgtctgaaatacgccgttctcgatccagtacagcgtattttcacctggacgtaaattaaaggcggtcagataggcatcagcggccagacgattctcacctttcatttcgtaaactttccccaacaggacatagttaaaccacgacatttcaagctcgatgcttttattgatttcctcatacgctgcatcgatatcacctttgcccaaaagatcaacggtcttgattttataataaacagacgttttctcaacgcccggaatttgatctatttttttaaactcttcgttcagcgcagccacttgttctttatcaaacggctgttgtgattgccgtaatacatctaccagcactttatattcataggcatagttgaaatcaggcgtttccttaataatgccattcagaatatcgccggctttacttagcgcctgcgcatcgccgctcagaataagctggcgcgcctcataaaaacgcatcagcgcggtattttgcggcgttctgaacagggccagttgttctcgcatacgattaggccagggctgtgttaaaacgaaagacaggctattaaacagatcatcctggatggacaactggttagtattggtgacgaaataacgcttatccagcatggttgaaccatcggcgttatcaatgagcaccacagacataaagcactgctgcgcccgatagtggcgctgattgacaaactgaatggttaacgtcttaccggagttgcttggctcattgacccggtaattggttttatcgtgcaccataaaggtcgagtaggtgttcagcaggtcggtgattaagccgcccagaccgatggcgtaggactcctgcgagacccagttattacaggaattgccgccttcaaaacgaacatctatatctcgtgggttaagtaataaccgcgtttttgttaccgcggcattatgatctaccaccgacatcacgataaacaccaccagcgtcgccagcgagagcaggaacatcacccacgtccagaaagcggcgatacgcggctttttcgcctttttagtcggcgtttgcaaagaggcgggcggcacaggcgcagcggcaggaaccccctctgtcggttctgcattcgtcgctgcgatcggcggcggcggcgacgttgataaattatcgatctcatcgctattttcttcgcaccagataaccggcgccgtcagcttatagccgcgtttaggtacggtaacgatgtattcagcattgctgtctccgccatctcttaatgatttgcgtagttcagaaatgctttgggtgacaacatggttggtcacgatggtgcgcatccagacatgatcaataatgttatcccggcttaacacttcatccggatgatgcgcaaaatacatcagaagatcgatcagccgtggttcaagagtaatctggcgtccctgacgactgatctgattaacagaaggtgtaaccagccactctccaatgcgtacaacaggttgctgcataaaaagatgccctaacgagctaagtcaaacgttaataataacacgatttgcacagacttttttattccccttttttgtaaaagaaaggcataaaaagcagcgcaataagcaggagaacggggaggaaaacgggcgttcgccttaacgataacgcccgttttttcagcggatttcttgcaattacagcactttatgcgggccgaagcattcgtaatgaatgttttcgttattcacgccaagtgaaaccagttgttttgcggcaaactgcataaagcctaccgggccgcaaagatagaactgcattgccggatcgctgatcgcggcttccagtttgcttaaatccatcagcccttcgctgtcaaagacgcgttgggcgcgatcggcctcggttggctcgcggtaccaggtatgggcagtgaaacgcggcagtgtacggcccagctcgctcacttcgtcggcaaacgcatggacgtcgccgttctccgccgcgtggaaccagttcacctgcgcggtatgctgttctttcgccagcgtatcgagcatcgccaacatcggcgtctggccgacgccagcggaaatcagcgaaacgggggtatcagcggcgacattcataaagaagtcacctgccggcgcagccagatgcaccacatcgcctacgttggcgtgatggtgtaaccagtttgatacctggccgccgtcttcacgcttcacggcaatacggtaccctttgccatcgggtttacgggtcagtgaatattggcggatctcctgatgcgcaaaaccttccggcttcagccagacgcccagatactgcccgggacggtattccgccaccgtaccgccgtcgaccggttcaaactcaaagctggtgatcagtgcgctacgcggggttttcgcaacgatgcggaaggggcgcgtgccttcccagccgccgtctttgctggcgttctcgtgataaatctcggcttcccgatgaataaagacgttagccagtacgccataggctttaccccatgcgtccagcacttcctggcccgggttgaacatttcatccagcgtcgccagcagatgcgtcccgacgatgttgtactgctccggcttaatctggaagctggtgtgcttctgcgcgattttttctaccgccggcagcaacgccggtaaattttcgatattgctggcgtaggccgcgatagcattaaacagggcttcgcgctgatcaccgttacgctggttgctcatattgaagatttctttgagctccgggttatgcgtaaacatacggtcgtagaagtgggcggtcagtttcggtcctgtttcaaccagcaggggaatggtggcctttactgtagcgatggtttgtgcgtcaagcatacgtgcttcctttatgtgaaaatctaataatgtatatcaaatgcatcttataaaaatacccttgcattgtaaatggatcttctctgctttacgttatggaggtaacaacgtgaaaaatctgcatcacaaagctgaaaagaaatccgttgaaattcgtcaggctctcgttcaggaaacccttatctgacgcataggtaatcgtttgcgtaaaaacctttgtcaagacctgttatcgaagaatgattcggttatactgttggccgaagtcccacggactgccttttcaggcacaaattttattgttagctgagtcaggagatgcggatgttaaagcgtgaaatgaacattgccgattatgatgccgaattgtggcaggctatggagcaggaaaaagtacgtcaggaagagcacatcgaactgatcgcctccgaaaactacaccagcccgcgcgtgatgcaggcgcaggggtctcagctgaccaacaaatacgctgaaggatatccgggcaagcgctactacggcggttgcgaatacgttgatgtcgtagagcagctggctatcgaccgcgcgaaagaactgttcggcgccgactacgctaacgtgcagccgcactccggttctcaggctaacttcgctgtttacaccgcgctgctgcagccgggcgataccgttctgggtatgaacctggcgcagggcggccacctgactcacggctccccggttaacttctccggtaaactgtacaacatcgtaccttacggtatcgatgagtccggtaaaattgactatgacgagatggcgaagctggccaaagagcacaagccgaagatgattatcggtggcttctctgcctactccggtgtggttgactgggcaaaaatgcgtgaaatcgctgacagcatcggcgcatacctgtttgtcgacatggcgcacgtggcgggcctgattgccgcaggcgtttacccgaacccggttccgcacgctcacgttgtcaccaccaccacccacaaaaccctggcgggtccgcgcggcggcctgatcctggcgaaaggcggcgacgaagagctgtacaaaaaactgaactccgccgtcttcccaagcgcgcagggcggcccgctgatgcacgtgatcgcgggtaaagcggtagcgctgaaagaagcgatggagccggagttcaaagtttaccagcagcaggtggcgaaaaacgccaaagcgatggtggaagtgttcctgaaccgcggctacaaagtggtgtctggcggcactgagaaccacctgttcctgctggacctggtggataaaaacctgaccggtaaagaagctgacgccgcgctgggccgtgctaacatcaccgtgaacaaaaacagcgtgccgaacgatccgaagagcccgttcgtgacctccggtatccgtattggttctccggcggttactcgtcgcggcttcaaagaagcggaagtgaaagagctggctggctggatgtgtgacgtgctggacaacatcaatgatgaagccaccattgaacgcgtgaaagcgaaagtgctggatatctgcgcccgcttcccggtttacgcgtaagcgtttgtgttgtgtaaatggcccgatggcgctgcgtctgtcgggcattacttatgcgccataacgtgacgccgccggaagtcattatccggcggcgttgccgtttgaacttctccctccgcctgttacccttgccagcgcaaccgtttaccgccagactatcgcctccaaacgggagggaatcatggcattgcattccacgcgctggctggcgctcagttatttcacctacttctttagttacggtatttttctgcccttctggagcgtctggctcaaaggtcttgggctaacgccggaaaccatcggtcttctgctgggcgtgggtctggtcgcgcgttttctcggtagtctgctcattgcgcctcgcgtaagcgatccttcgcggttgatctccgcgctgcgcgtcctggcattgctgacgctggtatttgcgctggcattttgggcaggaacgcatgtcgcgtggctaatggtggtgatggttgggtttaacctcttcttttcaccactggtgccgctgaccgatgcgctggccaatacctggcaaaagcaaattaccctggactatggtcgggtgcggctgtgggggtccatcgccttcgtgatagggtcggcgctgaccggtaagctggtgagtttatacgattaccaggcgattctggcgctactgacgctcggcgtcgcctcgatgttgctgggtatgttgttacgtcccagcgtgccgccgcaaggggaaagccgtcagcaggagagcgcaggctggcccgcctggcgtacgctggtggcacaaagttggcgttttctcgcctgcgtctgtttgctgcaaggggcgcacgccgcctactacggttttagcgccatctactggcagggggctggctattcagcatcggcggtcggctatttatggtcgttgggcgtggtggcggaagtgatcatttttgccctgagtaaaaagctattccgccggtttagcgcccgcgacttgctgttgctttctgctgtgtgcggcgtggtacgctggggactgatgggctggagtacggcgttgccgtggctgattgtgatacaaatcctgcactgtggcacgtttaccgtttgccatctggccgctatgcgctatatcgctgcgcgtcagggaagcgaggtgattcgtttgcaggccgtctattccgctgtggcgatgggcggcagtatcgcgattatgacggtatttgccggttttctgtatcaacatctgggcggcggcgtattctggattatggcgctggtggcattgcccgctatcttccttcggcccaaagtggttgccgcgtcatgattccaggatcttgcggatctgctgctgttggtgctctgtgagggcgcgatccgcatgaattaatggcggtgagaagagcggtagcggcgtggcgtaaggggtaacaatcagcgctacgccgcgcgggcatccctctttttgaaacgcctggagcgatatccgtctgatattcagcggcaatagggtcagttcacgcagttgctgctcaatatgcgtctccagcgcatcatttttatccgctaacaatacgatctgtctctcatgcaaatcgttatcctgcatcagccaggcgccgaaaatcactgccaccagccccgtctcttcctcggaaaagtggataccatattcggcttcaaacccggcgagcgcctcacgtgtggtgcgaaccagacgcggataaagacggttgaactcttccggaagcgtattatcgatgccaatcgtgaataaacttcggttcagcgcctgggcgagatggacatacagctgatcgttaagcccttgttcgtcgctgaagcgtacgttccctttttctcgaaagcgcagcaccagccgcgccacctccagtcgcagttgctgcgcccgttgatgcgtgtcgcgaatcgggtcggggaggcgaatcattgaaaacagtaacgccataaacagcgcttcattgagcggtgcggcctgcatcacgtggcgctgccagtgacgaccaatttcctgggcgagtggatattccgcacacgactgcgcccaaatctgctgtacaggattgaattccggggtgatgccggcatggtgttgtagcagacaatactgtaaaaagagacgcaggaactgcacgtcgcgatgttcaaatggtttttgcaaccggcgggcgcacagattgatgagcgcgtgcagattaatatcgtcatacagcggacgcgcgataccgcgctgctttagcgcgttttttaaggccggggtaaactgttgcgtgacgaaggtcgggcataaacgcaggccgcgcctgagccagtgtaaaaggcaaaggcgctgatcgagtgctgtaccttcgatccgatagcaaccgttctggcatgttgtgatggcaaggcgatgatagcgctggatctccaggcttgtgtcagtgatatcctcacgggcagtatcatcatcaacgccattaagcgcgctgaagatttccaccgtggcaattggctccggctggaaaagcgtcagcaatacctgacagcggcgctggggagcggaaagtacagatggtggggcaattgtcggcatcatctgtcaggtctcccgttagtttatctggtaaggatagctaaagtttgcatgtgaaaaatgtgataagtgtgcttttaggccaggaatgctgaggagtgtcacagaatttttatcgcgaggaacagatgaagccagtgaaacgcagcgccttaatactatttctcgccgttttatctttcgtggcggcggcgcatccgcacagcttcatccgtctgcaaacgcaggtggtcagtgaaaatgagcaatttgtggcgttaaaaatgcgctggacaatggacgcgctgacgtccgccgatctgctgtatgacgccggaaacgcggcgccgggttcagaaatatggaaaaagttggcggcggaagtgatggctaacgtacttgggcagcactactttacagaagtgtggcgcaatggcgcgaaagtgaagtttaaaaacaggccgacagaatacggtatgacgcgtgacgcgcatcaggcggtattgacctttacgctgccgctggctgaaccgcagccgttaagcggccagacttataccttttcaacgtttgatccctcttattatgtcgatatgcattatgaccaggacagcgatatcacgatgccggaaccgctgcgcgaaaagtgtcggattcaggtttatactcctgcgcccggcgaagagacgctacgtttcgcccagtcgctggataaagaggacgcgccgccggaggatatggatttaggtaaacagtttgcccaaacggtgaccttgcaatgtcagtaattttttctcaacgcactccggggcgacgctggctctcgctgtggccattggcgttattcctgctgctgatgctggttggcggtctgtggatatggcaggcctggccgcaggtgatgctgaaaagcgctctttggcagcgggacgtgaatcagcagttgagcgcgctgcttaatgcggtggcgacgcatcctgagcgggcgggcggatcgttgcttctgctgagttttatgtatggcgtgcttcatgcgtggggccgggacacggcaaagtggtgatcgcgacatggctggcgacgcatccttcgaagctgaaatcaagtatcgtgttaaccctcgccgccgcgttattgcagggggtcgtggctatcgggttggtggtgggcgtgctgaccgtattgcaacttccggccaggcagctccatctgagcggtttctggctggaaaaggggagctatgcgttagttggcgggctgggcatcttgctgtgctggcgggccataaaaaggttacgcgcgctgctacgtaaacctgtctttatcgcttttacgccgcgccatgttcaccatgaaaaatgcggctgcggacatcagcatctaccgacgcaggaacaattgcatagcggcgatgactggcgcgcgcgactcatgatcgtactgtctatggggatgcggccctgttccggagcgataatggtgctgttattcagtaaagtgattggcgtttttagctggggaatggcgtcggtactggcaatggcggcgggaacctcgctaacgattacttcgctggcgctgctggtacacacttttcgtgctctggcggtgaagctcagtggaaacaaagcgccggcgttatggcggcaggtaggctggtcaacgctggcgctggccggaggggtcatactgcttgtcgcggcgctggtcatgtggtttagcgtgccgcagcctgtgggcgggctgcggccatggcgtggttgactagtgcccggcgggtttgagatgcatccgcgcgacggattcgtcttcggcccagtaaatgcgttcggcgaccatcgcttccggattgagctgaacgccgcgcagtacccgttctttaaaacgcagatagccgcctttgtcgatcagatggcccatatgtagatagatcggttttccgccgagcatctctttttcaaattcatacaggttaacgatcacctgctttatcacatcttcagtcacccagttgaggaagagcttgccgacgcgcggcgtctttttactggtgcgtccgcccagacggacttgccagagctgatccggcttacgttgccaggccagcgtcggacaggccagcacgcactcgccgcagccgatacaggcggactcttctttgaccgctttgccgttcttcagcgccaggcagcctaccgcgtggtgactacaggccttcacgcaggcgccgcaaccgatacagcgatcggcagtgaagcgcattttcgccacgccaataattcccagatcggccattgacgccttcgcgcaatcattcgggcagccaacaatgaccgttttgagatgataagggctgggatagaccagtttttcaagacgacgggacagaccggtcgtgtcagtgttggctttctggcaaatgcggttcccctgacaggcgacaatatttcgcccgccaatagcgagatagcccgctttggtatcctcaacctggacgtcgcacagttctatttcaatctcgcgaagaaatggctccagcgcagcgttcacgttgtcgatatcttcgtaacggatacccggcatcgccagcttctggcgggtagtgaggtgaatttgtccgttgccccaggtttcggcgatgtcacgcgccaccgttagcaaatgcgcgggcaaaataccgccgggaatgcggacgctgatcatggcttcgccgcgcacttttgataggcgatattcgtttttcgcacgggctttaatgatatcaatatcaatgctcatgatgttctccttaatcggcaaaacgttgcgcgacggcgtagttaaatatcgggccgtcggtgcagacatacacttcgcccatacggcagtggccgcacttcccgacggagcaggccatccggcgttcgtagtccacccaaatttgctccggcttgagccctttttgcagcagcatttttacggtaaaggtaatcattattggcggcccaacgacgatggcctgcatggtgtcgatatcgctaagcgtcatgtcggcaagccgatcggtcacccgaccaatctggtaacggtcatcagcctcgccttcatccagcgtgagcaccagattatgtttgccgtgccacgtcgccatttcttctttgtacagcacgcaatcgcgatttttatagccgagaatcatatccagttgaccaatttcctggggattctcaacgaaatagcgcattaagcctttcaccggcgcgacgcccgtgccgcctgcgacaaccagtaagggtttatggcgcagagtatcgaccggatagccattgccatagcagccgcgtagccacacgttgtcgccttctttcagcgtaaagagggcgctggtcacttttccgacattacgaatcagcagatctatccagccatcgccgtagtcggaaacggagatgggcgcttcgccgacgcgcggcagcgacacctcaacaaattgcccccagtgcgcgggaaaatcgacggccacgcggaaattccactccagcggcgtgtggcgagtaatactgaggatgcggtacgccgcaggcagcaaactgtgctgcggtttatcatgacaggaacaatgtgacatgcgttatgcctcctctgccagcgcctgccgaacggcagcggtcattttgttaataatcaaagaaaatttgatgtattgcgggcagcgatcgtcgcagcggccgcagccgacgcacatatgttcaatgccgttgcgcgctttgtagtcattgaccttatgcagggcgcggtagcgcagacgctcgccgggtttttcgcgaaaaccatgaccgccggccatgtcgctaaagcccggcaccatgcagcttgcccactggcgacggcgttcgccgcgctgcggattttcatcataggcgacgtcaaagacgctatagcaggtacaggttgggcacccggtagtacagcggccacaactgatgcagcggctgtcgtaggcgtcccatagcggatggcgagtgagaatgtcgcgaattttttgcggatcgcggcaaacgctgtccggcgtgacgacggtttcccggttttcgctgacgaaagagggggtatagtcagcctcctgccccagtccttgtatcgccgcctcgataaagggatcgcggatgctcacaagcgcgccctcatcgctaaaacgcatggcggcgctataacagtcagttttattagtacccattgagacgcagaaacaattttcgaagctttcttcacactcaataaggacgaaacgaatatgctcccgtagcagttgataactgtaatcggaattattcccatttgataaatacatataatccagccgcgacatggcgttaatgtcgcaggcgcgggcaaagatgattatcggggaggtgtctgtctcggcaatttgaatggtgtttttatcgaaataaaagagcgtttcggtgataggggcgataatggtattcggcgacatgtgcgatttctcgtgccagatgagatcgcgccagccgctaatccgttgataaataatgttgtcagtgtcggaaaaacgcccgccgcgaaactctgcggacggggcaaacacgcgccattttttgtttaatcgctggataagcagactaaactcgtcaggcgtaattttgatagccatcacatactccacagtaatattcaggaaaaacaaatgaaaataaattgttataaaaatcagatgaatattactgttacgctagcgctaatccgccgccttcgctaacgggaaaaaatggtttttactatcggtataataaatatattcttaatcataaaatatgcatatatacagcgtcgcgctatttagcggatagcgctgtctgaataaaattaatcatcgcatcgcggtaaaggtttgcataacgtccggaaaaagcatcaatgtgatcgccgtcaggaatgaagattttttgtttgggctcccgggcgagggcatacaatttctcactgtcctgccagggaataacatggtctgccgtgccatgaagaatcaataccggaatggggctgacgctggcgatattgcgatccgcgctatagcggtcatcaagcaaatagccgctgcccgggatcatctggttggcgatggaggaataggatgaaaacgttgagtcgaggacaatcgcacgtatgcccgcctggtcggcgtagcgcatatttgcgcagcctacgcagtggcctacggcggccagtacattattgccgcccaggctctgccccagcagtaccaggcgctcggggttaacgtcggcacgatgccgcacataatctatcgcgcttttcgtatcgttcagtagcccctcttgtgatggggtgccctcagattcgccaaacccacggtaatcaaacataaacaggtttacgttgcgttctggcagccaactgactaacggccagtgcgccgacatatttccggcgttgccatggacatgaatcaccgtcgcgacggcgttttccggcctgccgaaagcagtaggaataaaccagccgtgcagatgcgtgccatctttggcggtaaaggtaatggattcagcttcggcaggggttggtccatagactttattgtccgggtaataaaaggcattgatcgctacgcggggtagcaggtaaatacagactacaatgataaacagaataaaaagggatttgacgatgcgtcgggtatgttgaagggtcatgttcgcttccttgccgctttatgtccatagcggagcagggagcgatcgtacaaaaacatgcaggcaagtaaagcgatgaggtggtgtttaggaaaaacgcctgaaaaggcacggcggatgagtggccccatccgccgaagagacttagcgcttcagcgcatcgctcagttcgtcgcgcatattcgccagcatggctttaacgacgcgcggattccccgccacgatattaccggtcatcatgtagttatgaccgccggtgaaatcgctgacgataccgcccgcttcacgaaccagcagttcgcccgcggcgaaatcccacggacgaaggccaatttcaaagaaaccatcgacacgacctgcagccacataggccagatccagcgcggcggaaccggtgcggcggaaatcggcgcattcggtgaacagcttgccgataatattaatgtaggtggtcgcgtattgtttggctttgaacgggaagccggtagcgaggatagtgccgtccagatcgcgcgcggtactgccgcgcagacggtagccgttcagctgcgcgccctgaccgcgggtggcggtgaacagttcgttacgcatcggatcgtaaacgacagccacttcagtacggcctttaatgtgtacagcaatggaaacagagaagtgtggcagacgtttgatgaagttggtggtgccatccagcggatcgataacccattgaacatcctgatctgtgccaacgtgctcaccgctttcttcggtgataatagtgtgttgcgggtaagatttgcgaatggtgtcgataattaccgcttcagcggccttatctacgttggtcacaaaatcgttactgcctttttggctcgcttctgcagcgtccggagtttcatagtttttggcaattacattacccgccttgcgcgctgcgcgcacggcgatggtcagcatcggatgcatcggtctctctcactggatgttaaagaacgggaaaacggcgcagagtatagcagcgagatcggaatctgtcttggttttatggtaagatgtccgaataatctttagctgaagaaagacaatgctgcaaaacattcgaattgtgctggtggaaacctcccacaccggcaatatgggctctgtggctcgcgctatgaaaaccatgggcttaactaacctgtggctggtaaacccgctggtgaaaccggactcccaggccatcgccctggcggcaggcgccagcgatgtgatcggtaatgcgcagatcgtcgatacgctggacgaagcgttggctggctgtagcctggtggtcggcaccagcgcccgctcccgcactctgccgtggccgatgcttgatccgcgcgagtgcggcttaaaaagcgtagcggaagcggcaaatacgccggttgcgctggtttttggtcgtgagcgtgtcgggctgactaacgatgagttgcaaaaatgccattatcacgtcgcgattgccgctaacccggagtacagctcgttgaatctggcgatggcggtacaggtcatcgcgtatgaagtccgcatggcctggctggcgacgcaggaaaacggcgacgcggcagatcatgaagagacaccgtatccgctggtggacgatcttgaacgtttttacggccatctggagcagacgttgctctccactggctttattcgcgaaaaccatccggggcaggtgatgaataaattgcgccgtctgtttacccgcgcccgcccggaaagccaggagttgaatattctgcgtgggattctggcgtctattgagcagcagaataaaggcaagtaaccgcgttaatgccggatggctcttcgcttatccgacctacaaatcgtgcggcctgtaggccggataagcaaagcgccatccggcacatcaataccgcacggaacgctaaatacctgactaatttactcaagtaaatagttgaccaatttactcgggaatgtcagacttgtccctgctatgcaatacccccattttacaataaaaaaccccgggcaggggcgagtttgaggttaagtaagacatgagactgacatctaaagggcgttatgccgtgaccgcaatgttagacgttgcgctcaactccgaagcgggcccggtaccgttggctgatatttctgaacgtcaggggatttccctttcttatctggaacagctattttcccgtttacgtaaaaacggtctggtttccagcgtacgcgggccgggcggcggttatctgctgggtaaagatgctggcagtatcgcggtcggcgaagtgatcagcgcggttgatgaatccgttgacgcgacccgttgccagggcaaaggcggctgccagggcggcgataaatgcctgacccatgcgctgtggcgtgatttaagcgatcgtctgaccggttttctcaacaatattactttaggcgagctagtgaataaccaggaagttctggatgtgtctggtcgccagcacacgcatgacgcgccgcgcgccagcggtcgtgcgcaggacgctatcgacgttaaattacgcgcttaattaaaatattacgccatctcttctggcggcctcatgcggtgaatgccgcggtcgtctgaaggatgaagcgtaaaaaagaattcagaatcaggccgggacgcggacgtcccgtcaacacggtcgtacatccagccggttgcctgattccttgcattgagtgatgtacggagtttaagagcaatgaaattaccgatttatctcgactactccgcaaccacgccggtggacccgcgtgttgccgagaaaatgatgcagtttctgaccctggacggaacctttgggaacccggcgtctcgttcacaccgtttcggctggcaggctgaagaagccgtcgatatcgcccgcaaccagattgctgaactggtcggcgccgacccgcgtgaaatcgtctttacctcaggggcgacggagtccgataacctggcgatcaaaggcgctgccaacttttatcagaaaaaaggcaagcacatcatcaccagcaagaccgagcacaaagcggtgctggacacctgccgtcagcttgagcgcgaagggtttgaagtgacctacctggcgccgcagcgcaacggcatcatcgatctcaacgagctcgaagcagcgatgcgtgacgacaccattctggtttccatcatgcacgtgaacaacgaaatcggcgtggtgcaggatatcgcgaccatcggcgaaatgtgccgcgcgcgcggtatcatctaccacgttgacgccacccagagcgtgggcaaactgcctatcgacctgagccaactgaaagtggatctgatgtccttctccggtcataaaatttatggtccgaaaggcattggcgcgctgtatgtgcgtcgtaagccgcgtattcgcattgaagcgcagatgcatggcggcgggcacgagcgcggtatgcgctctggtactctgcctgttcaccagatcgtcggcatgggcgaagcttaccgtatcgcgaaagaagagatggagaccgaaatggcccgtctgcgcggtctgcgtaaccgtctgtggaacggcatcaaagatattgaagaagtttacctgaacggcgaccttgagcagggcgcgccaaacattctcaacgtgagctttaactacgttgaaggcgagtcgctgatcatggcgctgaaagacctggcggtctcttccggttccgcctgcacctccgccactctggaaccgtcctacgtgctgcgcgcgttgggcatgaatgacgagctggcgcatagctctatccgtttctctttaggtcgttttaccactgaagaagagatcgactacaccattgatctggttcgtaaatccattggccgtctgcgtgacctttctccactgtgggaaatgtacaagcagggtgtggatctgaacagcatcgaatgggcacatcattaatcggtatcggaatcaggagaatttataatggcttacagcgaaaaagtaatcgatcactatgagaacccgcgtaacgtagggtcgtttgacaacaacgacgataacgtgggaagcggtatggttggcgcgccggcctgcggcgacgtcatgaagttgcagattaaagttaacgatgaaggtatcattgaagacgcgcgcttcaagacttacggctgcggttccgctatcgcctccagttctctggtaacggagtgggtgaaagggaaatccctggacgaagcgcaggcgattaaaaacaccgacattgcagacgaactggagctgccgccggtgaaaattcactgctctattctggcggaagacgcgattaaagccgctattgcggattacaaaagcaaacgcgaagcgaaataaaatagaacgttaacattgaggttttgttatgtcgattacacttagcgacagtgcagcagcgcgagttaataccttcctggccaaccgtggtaaagggtttggtctgcgtctgggcgtgagaacctccggctgctcaggtatggcttatgtactggaatttgttgacgagccgacggcggaagacaccgtgtttgaagacaaaggcgttaaggtagtggttgacggcaagagcctgcaatttctggacggtacacagctggacttcgtaaaagaaggcctgaacgaagggtttaaattctccaacccgaatgtgaaagatgagtgtggttgcggcgaaagcttccacgtgtaactgtgttccgctgttataccgagtcattcgtgctgcagaaaagcggcaagcgagtgaatccccaggcgcttacttaagtaagtgactgggggaacccgcgcagacaacgcatctgcggcgcgaagtaagaaggtataaccccaccgtggtcgcctgcgtgtggggtttgttctgacaggctatccctgagaatgttatggattacttcaccctctttggcttaccagcccgttatcagattgacacccaggcgctgagctttcgttttcaggatctgcaacgccagtatcaccctgacaaatttgccaacggcactcaggcgcagcagcttgccgccgtccagcaatccgccacgatcaaccaggcctggcaaacgctgcgtcaccctttgacgcgcgcggagtatctgctttccttacacgggttcgatctggccagcgagcagcatacggtacgcgacaccgcgtttctgatggaacaactcacgcttcgcgaagagctggacgatatcgaacaatcaaaagacgacgcgcggctggaaagcttcatcaaacgcgtacaaaagatgtttgatgctcgtcttcagcaaatggtggaacagttggacaacgccgcgtgggacgcggcggcggatacggtgcgcaaactgcggtttctcgataaactgcgaagcagcgcagaacaactcgaagaaaagctgctcgatttttaactggaatctaacatggccttattacaaattagtgagcctggtctgagcgccgcgccgcatcagcgtcgtctggcggcgggcatcgacttaggcactaccaactctctggttgcgacggttcgcagcggccaggcggaaacactgcctgaccacgaagggcgccacctgttgccttcagtggttcactatcagcagcagggccatacggtcggttacgctgcgcgtgacaatgccgcgcaggatacggccaacactatcagctctgtgaaacgcatgatgggacgctcgctggcggatatccaggcgcgctatccgcatctgccttaccggtttaaggcaagcgttaatgggctgccgatgattgacacggcggctggattgctcaatccggtacgcgtatctgctgatattctcaaagcgctggccgcgcgggctagcgaatcgctctccggcgagctggatggcgtggtgattaccgttcccgcctatttcgatgatgcccaacgtcagggaacgaaagacgccgcgcggctggcaggcctgcatgtactgcgcctgctcaacgaaccgacggcggcggcgattgcctacggtctggactcaggcaaagaaggcgttatcgctgtttacgatctcggcggcggtaccttcgatatctctatcttacgcctgagccgcggggtgtttgaagtgctggcgacgggcggtgattctgcgctcggcggcgacgactttgaccatctgctggcggactatattcgcgagcaggcgggaattgccgatcgtagcgacaatcgcgttcagcgcgaactgctggatgccgcgattaccgcgaaaatcgccttaagcgatgccgatactgttcgcgttaacgttgcgggctggcagggggagatcactcgcgagcagtttaacgatctcatttccgcgctggttaagcgcacgctattggcctgccgtcgcgcattgaaagatgccggcgttgagccccaggacgttctggaagtggtcatggtcggcggttcgacccgtgtaccgctggtgcgtgagcgggtgggcgaattttttggccgcacgccgttaaccgctatcgacccggataaagtgatcgctatcggcgcagcgattcaggccgatattctggtcggcaacaagccggacagcgaaatgctgctgctggacgtgattccactctctcttgggctggaaacgatgggtggcctggtggaaaaagtcattccgcgcaacaccactatcccggtggcgcgcgcgcaggatttcaccaccttcaaagacagtcagaccgcgatgtctatccatgtgatgcagggcgaacgcgaactggtgcaggactgccgctcgctggcgcgctttgcgctgcgcgggattccgccgctgccggcgggcggggcgcatattcgcgtgaccttccaggtagacgccgatggcctgttgagcgtcaccgcaatggaaaaatccaccggcgtcgaggcctccattcaggtcaaaccttcctatggcctgaccgatggcgaaatcgcctcgatgatcaaggattccatgagttttgccgagcaggacgtgaaagcgcgtatgctggcggagcaaaaagtcgaagccgcgcgcgtgctggaaagtttgaccggcgcgctaactgccgacgccgcgctgttaagcgccgcagaacgtcaatgcattgatgatgccgccgcacatttaagcgcggtcgcacaaggcgatgatgttgacgcaatagaacaagccattaaaaacgtagataaacaaacccaggaatttgccgctcgccgcatggaccagtcggttcgtcgcgcgttgaaaggccattccgtagacgaggtttaacatgccgaagattgttattctgcctcatcaggatctttgtccggatggcgcagttctggaagctgagaccggtgaaaccattcttgacgttgcgctgcgcaacggcatcgagattgaacacgcctgtgagaaatcgtgcgcctgcaccacctgtcactgtattgtacgtgaaggcttcgactccttgccggaaagttcggaagaagaagacgatatgctggataaagcgtgggggctggagccggaaagtcgactgagctgccaggcccgcgttaccgacgacgatctggttatcgaaattccacgttacacaatcaaccatgcgcgtgagcattaacagagggtagtatgggactcaagtggaccgatagccgcgagatcggcgaagcgttatacgacgcatatcctgatgtcgatcctaaaaccgttcgtttcaccgatctgcatcagtggatctgcgaactggacgattttgacgacgaccctaacgcatccaatgaaaaaattctggaggcgattctgctagtctggttggatgaagcagagtaagtcaaataacgggctgccctacgacggcccgtttgctaataaggaaaataacaatgacagaagccatgaaaattacgctttccacgcagcctgccgatgcgcgctggggcgataaagccacttacagtattaataacgacggtattaccttgcatcttaacggtaaagacgatctggggttgatccagcgtgcggcgcgtaaaatcgacggcctgggaataaaacaggtcgcgctgacaggcgaaggatgggataccgagcgttgttgggcattctgggcgggttacaaaggaccaaaaggcgtccgtaccgtaatgtggccggatttagacgatgcccaacgtcaggagctggataaccgcctgaccattattgactgggtgcgcgacaccattaatgctccggcggaagagcttgggccggagcaactggcgcagcgcgcggtggatctgctgtgcagcgtcgcgtgcgatagcgtcacttaccgtatcaccaaaggcgaagatctgcgcgagcagaactatatggggttgcataccgtaggccgtggttctgagcgtccgccggtactgctggcgctggattacaacccgacgggagacaaagatgcgccggtttatgcctgcctggtcggtaaaggtatcacctttgactccggcggttacagtatcaaacaaagcgcttttatggactcaatgaaatccgatatgggcggcgcggcgacagtaacgggcgcgctggcgttcgccattacccgtgggctgaataaacgcgtaaaactgttcctgtgctgcgctgataatctgatcagcggcaacgcgtttaaactgggcgatattattcgctaccgtaatggcaagaatgtcgaagtcatgaataccgatgcggaagggcgactggtactggcggatggcctgattgacgccagcgcgcaacacccgcggctaatcattgatatggcgacgttaaccggcgcggcgaaaacggcgctgggtaacgactaccatgcgctattcagttttgacgatacgctggcggggcgcttgctgaccagcgcggcgcaagagaatgagccgttctggcgtctgccgctggcggagttccaccgtaaccaactgccgtctaactttgcggaactgaacaacaccggcagcgcgacgtatcccgccggggcaagcaccgccgcgggttttctgtcgcactttgttgaaaattaccgcgaaggctggctgcacattgactgttccgccacttatcgcaaagcgccggttgagcagtgggctgccggggcaaccggtctgggtgtgcgcaccatcgcgaatctgctgaccgcctgaacggtgtttttgtaggccgggtaagcgaagcgccacccggcattttgcctgatggcgacgccgtgcgtcttatcaggcctacaacccatatacataatttgtgattcctatgtccgaaactaaaaatgaattagaaattttgctggagaaagcggcgactgagcccgcgcatcgttcggcatttttccgtaccttactggagtccaccgtctgggtgccgggcagcgctgccgaaggcgaggcgattgtggaagacagcgctctggatttgcagcactgggaaaaagaagacggcacgaccgtcattcccttctttacttctctggaggcgctgcagcaggccgtggaagacgaacaggcgtttgtggtgatgccggcgcgcacgctgtttgaaatgacgcttggcgaaacgttattcctcaacgctaaattgccgaccggcaaagagtttatgccgcgtgaaatcagcctgcttctcgctgaggaaggcagtccgttaagtacgcaggaagtgctggaaggcggcgagtcgcttattttatccgaagtggccgagccgccgtcgcagatgattgattccctcactacgctgtttaaaaccatcaaaccggtgaaacgcgcatttctctgcgcgattaaagaacatgcggacgcccaacctaatctgctgattggcattgaggctgacggcgaaattgaagagatcattcacgcagcgggcaatgtggcgaccgacacgttaccgggtgacgaaccgatcgatatttgtcaggtgaggaagggcgcgcagggtatcagccactttatcaccgagcatatcgcgccgttctacgagcgtcgttggggtgggttcctgcgcgattttaaacagaaccgcatcatctgaagaaaagaaagccgcccaacagggcggcctcctggcttacctgctctggacgttgagcgttacgggaacagaattacctgggtagcttctgtctgcgtgaagacacaacgtgccagaaacaagaagcacgacacaaaagcatcgtaccttcatgttgcggtccttgcgaagaccgcatcacggcagcaccgctggcgataatgccgtgatagcaggcactgtggtgtgcctgcgcttacggccatggaacatcctctcctgaagccagtgcccgtttgcgagacggcgaagggggccgggaaagataatacctcaaatgctgaatagtttcgtcgtgaattaacttgactttgctctccttaaaagggagtatttacctactgtggtgtgcctgcgttgctatggcaacaaagcctgctggaaaggccgcgaaccggaccagcacaaaaaaaccgctcaactgagcggtttttttgtggcctgcttaaacagtatttatgtagattcgttttaaatcagcctgaacggtaggccggataagcgtgagcgccacccgacagcatgtcgattaatcgacgagcgcgtccagttttgcccaaaacgcctcatgataatcctccaggtcaagtaaagcggcatcgcgttgttcattcattttttgctgtgccttccattgcggaagatgtaaatcctcttcggtaaagccaatgtctttagcgcccgaaataatattatagagatattccaccagagaagactccgccagccaaaattcattacgttccatgcgggcaatagggtattcgccgttggcatcccgttctgtgatatagataaaaatggcctgatcgccgacatgatcaatacgaattaatgccggaagacggggatcgttactccagacaggcatcagatcttcaatatcaatacctgagctatccatgccagcgccgtaatacgcctcttcatcaggagagtaagaatgtattactccctcgttatcaataaatctttgtaatgtttcaatcacaggcatattataattgctaagtagatcgcggtcgtaggccagtagcgccttcaggctttcaggtaactcagtggtttccgtattttgcggatcgcgatacttacgcactcgcagacaacttatttcctcggcaggcataggattaggcaccttattgcggttaacctttttaactagctccattaaattagtgagtgaaatatccattttccatccttaaaaaattatatttacaggagttatttcccggtgaaacccaaaacagcggtgatgatactccttatacccgacgtaaagtatttaccgataaaaaataggattttattaagagaaaataatgcccgtttgcaggacagtggaaaagagcggaataaaaacaatgtctgtagatcgttttacatcagcctgaacggtaggccggataagcgtgagcaccatccggcatggcggatattaagcgggttcaaccggtaaatcggtacgcgcgccccattcgctccacgcgccgtcgtaaagcgtgacgtcaggcacatccagcgtggcgagtgccagcaccacgaccgcggccgtcacgccggaaccgcaactggcgataatcggtctgtcgaaactcacgccgtggctgaaaaaaacctcattcagttcgtcagtggtctttaattcgccctcatacaccagttccgtccacgggacgtttagcgcgccaggaatgtgtccgcgtctcagtcccggacgcggttcatcagcctgagcgttaaaacgcgccgccggacgcgcgtcgacgatttgcgcggttttttcatggcttgccagcaatacgtcggtgagacgcaccacggcttgcggcgtgaatttcgcctcaaactcgcctccttcatgcgcttcttcgccttcgcgcaatagccattcgtcgcgctgccagcccgccagtccgcccgccagaatggacactttctcggcaccgaacgtgcgcagcatccaccatgctcgcggagcggagaacagattgccttcatcgtatatgaccaggtgtttatcctggcgaacacccagttcacgcatggccaccgcaaacgcttccgggcgcggcatcatatgcggcagcggcgatgcgcgatcggaaagcgcttcaatatcaaaaaacagcgcgccgggaatatgtccggcgcgatattcgcccgccatatcacgatgttcctgtcctggtggcgccatacgggcgtcaagaatctgtatttccggatcatcaatatgttcggcaagccagtcggcggcgacaaaaaaggcggtggtcatgggcatctccattgttacctgattatggtcaaattgtcggacgtttcccgaaaagggacaagtagaagaggctgttttggctggcgaaaccacatttctgcgtaaaattttcgcgtcatcacagtaatacggacttacacaataaaatttctcgcgcataatatctcatcaaccgttgctgacaggccgttaaggccagggatgaaagatgaaacatttacgcgtggtggcctgcatgatcatgctggcgctggcgggatgcgataacaacgataaaaccgccccgacgactaaaagcgaagcgccagccgtagcgcagccctcgcccgcgcaagacccgtcacagctacaaaagctggcgcagcaaagccagggcaaagcgctcacgctattagacgcctccgaagcgcagctcgacggcgcggcgacgctggtgctgacgttttcaattcctttagatcctgaacaggatttctcccgtgtggttcacgtggttgataagaaaagcggcagcgttgacggcgcatgggagctggcgccaaatttaaaagagctaaggttacgtcatctggaacctgagcgcgtgctggtggtcacggttgatcccgccgttaaagcgctgaataacgccaccttcggcaagtcttatgaaaaaacgattaccacgcgtgatgtccagcccagcgtcggctttgccagccggggatcgctgctaccggggaaaatagcggaaggactgccggtcatggcgcttaacgtcaaccacgttgatgtgaactttttccgcgttaagcccggatcgctggcgtcgtttgtcagccagtgggagtaccgtagttccctctctaactgggaatccgacaatctgctgaaaatggcggatctggtttataccggtcgttttgatcttaatccggcgcgtaatacgcgtgagaaactgctgctgccattaagcgatattaagccgctgcaacaggcgggcgtatatgtggcggtaatgaatcaggctggacactacaactatagtaatgccgctacgttgtttacccttagcgatatcggcgtgtccgcgcaccgttaccatagtcggctggatatctttacgcaaagcctggaaaacggcgcggcgcagtcgggaattgagatcgttcttctgaatgataaagggcagacgctggcgcaggcgacgagcgacgcgcagggacatgtgcaactggaggctgataaagcggcggcgctattactggcgcgtaaagaggggcagaccacgctgctcgatctcacgcttccggctctggatctgtcggagtttaatgtcgctggcgcgcccggctacagcaagcagttctttatgttcggcccacgcgatctctaccgaccgggcgaaacggttatcctcaacggattactgcgcgatagcgacggtaaaacgctgcccgatcaacccgttaagctggaagtggtaaaaccagacggacaagtgatgcgtaccgtcgtcagccagccggaaaacggactataccgtttgaattatccgctggatatcaacgcgccgaccggcttgtggcatgtccgcgccaacaccggcgataatttgctgcggagttgggatttccacgtggaagactttatgccggagcggatggcgctcaacctgacggcgcaaaaaacaccgctggcgcctgcggatgaggtgaaattctccgttgtcggctattacttgtatggcgcccctgctaacggcaataccctgcaagggcaacttttcctgcgtccgctgcgcgacgctgtcgcggcgttgcctggcttccagttcggcaatattgccgaagagaatctttcgcgcagcctggacgaagttcaactgacgttggataaaggcggacgtggtgaagtgagtgctgccagccagtggcaagaagcgcattcgccgttgcaggtaattctacaggccagcctgctggagtctggcggtcgtccggtcactcgtcgcgtagagcaggcgatttggcctgccgatacgttaccgggaattcgtccacagttcgccgccaaagcggtatacgactaccgtacggataccaccgttaatcaaccgattgtcgacgaagacagcaacgccgcattcgatattgtttacgccaacgcgcagggcgagaaaaaagcggtgtccggtttacaggtgcggctcatccgcgagcgtcgcgactattactggaactggtcggaaagcgaaggctggcagtcgcagtttgatcaaaaagatctggtggagggcgagcagacgctggatctgaacgcggatgaaaccggaaaagtcagcttcccggtggaatggggcgcgtaccgtctggaggtcaaagcgccgaatgagacggtcagcagcgttcgtttctgggccggctatagctggcaggataacagcgacggtagcggcgcggcgcgtccggatcgcgtcaccctcaaactggataaagcgaattatcgtccaggcgacaccatgaaattgcatatcgccgcgccggtcgccggtaaaggttatgccatggtggagtccagcgatggtccgctgtggtggcaggcgatcgacgtgccggcgcaggggctggagctcacgattccggtggataaaacctggaatcgccacgatctctatctcagtacgctggtggtgcgtcccggcgataaatctcgttccgcgacgccaaaacgcgccgtggggttactacatctaccgctgggggatgacaaccgccgcctcgatctggcgctggaaagcccggctaaaatgcgcccgaatcagccgctcaccgtcagggtgaaagccagcgttaaacacggcgaaatgccaaaacagatcaacgtgctggtctccgcggtcgatagcggtgtattgaatatcaccgattacgcgacgccggacccgtggcaggcgttcttcggtcaaaaacgctacggtgcggatatctacgatatttacggccaggtcattgaagggcaggggcggctggcggcgttgcgttttggcggcgatggcgacgaccttacgcgcggcggaaaaccgccggtaaaccatgccaatatcatcgcgcagcaggcgcagccgatcacgctcaatgagcagggcgaaggggtcgtaacgctgccgattggcgactttaacggcgaactgcgggttatggcgcaggcatggacagcggacgattttggtcgcggcgaaagcaaagtcgttgtcgccgcgccagtgattgccgagctgaatatgccgcgttttctggcgggaggggatgtttcgcgactggtgctggacgtcaccaatctgaccgaccgcccgcagacgctgaatattgcgctcgccgccagtgggttactggaactgcttagtcaacagccgcaaccggtcaacctggcgccgggcgtgcgcaccaccttattcgttccggtacgcgcgctggaaggttttggcgaaggcgaaatccaggcgaccattagcggtctgaatctgccgggagaaaccctcggcgcgcagcataagcagtggcaaatcggcgtgcgtccggcctggcctgcccaaacggtaaatagcggcattgcgctggcgccgggagagagctggcatgtaccagagcagcatctggcaaacgtctcgccagccacgttacagggacaactgctgttaagcggaaaaccgccgctcaatctggcgcgctacattcgcgagctgaaagcatatccgtacgggtgcctggaacaaaccaccagcgggttattcccggcgctgtataccaatgccgctcaattgcagtcgctcggtattaccggcgatagcgatgaaaaacggcgcgccgcggtggatatcggcatctcccgcatactacagatgcagcgtgataacggcggttttgcgctatgggatgaaaatggggcggaagagccctggctaacggcctacgcgatggatttcctcattcgcgcgggcgagcagggatatagcgtcccgccggaggccattaaccggggcaatgagcgactgctgcgctatctgcaggatcccggtacgatgctgattcgttatagcgataatacccaggccagtacttttgccgctcaggcttacgccgcgctggtactggcgcgtcagcagaaagcgccgctcggcgcgctgcgcgaaatctgggagcgccgtagtcaggcggcttcaggactgccgctgatgcaattgggcatcgcgttaaacacgatgggtgatgccagacgcggcgaagaggccattacgctggctctgaatacgccgcgtcaggacgaacggcaatggatagcggattacggcagttctctgcgcgataacgctctgatgttgtcgttactggaagagaacaacctcagaccggacgcgcaaaacgcgctattaagctcgctttctgagcaggccttcggtcagcgctggctctctacccaggagaacaatgccttgttcctcgccgcgcattcgcgacaggccagcgcgggcgcctggcaggcgcagacctcgttagaggcgcagccgctgtcgggcgacaaggcgctgacccgtaatctggatgctgatcagctggccgcccttgaggtgacgaacaccggtagccagccgctatggctgcgtctggatagcagcggctatccctcatctgcgcctgagcctgccagcaacgttttgcagattgaacgacaaatactggggaccgatggtcagcgcaaatcgctgtcctcgttgcgtagcggcgaactggtgctggtctggttaacggtagtggccgatcgcaatgtgccggatgcgctggtggtggacctgctcccggccgggctggagctggaaaaccagaatctggctgacagcagcgccagcctgccggagagcggtagcgaagtgcaaaatctgcttaatcagatgcagcaggcggatattcagtatatggaattccgcgacgatcggtttgtggctgccgtcgttgtcaatgagggccagcccgtgacgctggtctacctggcgcgcgcggtaacgccggggacgtaccagcttgcgcaaccgcaggtggaatcgatgtacgcgcctcagtggcgggcaaccggcgcgagcgagggactgctgattgtgacgccttaaatgaacggttggcgtggtaaacgtggccgctggctgtggctggcgggcgcgccgctttttattttcctggcgttatgggcagcggataaactctggccgctgccgctcaatgaggtccatcctgcgcgggtcgtggtcgcccatgacggtacgccgctgtggcgctttgccgacgccggggggatctggcgttatccggtgacgattgaagaggtctctccccgttacctggaggccttaatcaattacgaagatcgctggttctggcagcaccctggcgttaaccctttttccgtcgcgcgcgcggcatggcaggatcttaccgccgggcgcgttatttccggcggcagtacgctgactatgcaggtggcgagacttctggacccgcattcgcgcacgttcggcggtaaaatccgccagctttggcgcgccctccagcttgaatggcatttgtccaagcgcgatatcctgacgttgtacctgaaccgcgcgccgttcggcggcacgctacagggtattggcgctgcaagctgggcctacttcggcaagccgcccgcgcgcctgagctacgctgacgcggcgctgctggccgtattgccgcaggcgccgagccggttacgccccgaccgatggcctacgagagccgaagcggcacggaataaagtgctggatcggatggcggagcagggcgtctggcctgccgaaacggtacgcgagtcgcgtgaagagccggtctggctggcgccgcgtcaaatgccgcaactggcgccgctttttgcccgaatgatgttgagtaaaagccggagcgacaaaattgtgaccacgctggacgccgggttgcagcggcaactggaagatctggcgcgggcatggaaagggcggctgcctgcacgcagttcattggcgatgatcgtcgtcgatcataccgatatgagcgtgcgcggctgggtaggatcggtagaccttaatgacgacagccgttttggtcatgtcgacatggtaacggcgatccgatcgccgggatcggtactcaaaccctttgtgtatggtctggcgctggatgacggcttgatccatcccgcatcactattacaggacgttccgcgccgcaccggagattaccgcccgggaaacttcgatagcggatttcacggcccggttagcatgagcgacgcgctggtacgctcgctgaatctgcctgccgttcaggtgcttgaagcctatgggccgaaacgatttgcggcaaaactgcgtaacgtcggcctgccgctatatttgcctgctggcgcggcgcccaatctttcgctgattctgggcggcgcgggcgcgcggcttgacgagatggcggcggcatacagcgcgttcgctcgtcatgggaaagcggcgaaactacggttacagccggacgatccgctgtcggaaagaccattaatgtcgccgggagcggcgtggatcattcgacggattatggcggatgaagcgcaacccttgccggataacgcgctgccgcgcattgtgccgttggcgtggaaaaccggcaccagctacggctatcgcgatgcgtgggctattggcgttaacgcgcgctatatcatcggcatctggacaggcagacccgacggcacgcctgtggtggggcaatttggttttgccagcgcggtgccattgcttaaccaggtcaataatctgttactggcgcatacgggacgcctgccggaagatccgcgtccgcagacggtaagccgcggcgtcatttgctggccgggcggacagactctgcctgccgggaacagcaactgtcgccgccgactggcgacatggctgcttgacgacagccagccgcccacgctgctgttacctgagcaggaagacatcaacggtattcgtttcccggtctggctggatgatacggggcggcgtgtcgctgccgactgtccgcaggcgcgtgcgcatacgtttatcgtctggccgcggccgctggagccgtggctgccgcctgcggaaagacgtagcgcccgcttgcccgcggcgtccgaccactgtccgccgctacagggcaatgatgccgcgccgttaatgctgtcaggagtgagggatggcgcggtgatcaggcaattgccaggccaggaaaacgtcacgctgcccgtctcgactaccggcggcaaagggcgtcgctggtggtttttaaatggcgaacctgttaatggcgaaaataatcgcctttctttattactcaatatcgctggacgttatcaacttgtcgtaatggatgagtccggtcaggttgcagcggttaattttgaattaatacgttaaccattctccaaaatagattatcaattccttttaatttaagcttaatgataattgttaattattactggatcatacataaccggagagcttgataaatatcaagagaaccaacgcataaaaacgtgagaatgggtttttatttgacgagtcggatcatgaaaaatataaaaagccagggaaatggcgaacagcccgctatttctcgccgccattttatccaggccagctccgcgcttattgagttaccgtttgtctcctcgccagctaccgctcaggcgcgcgctgtgacggcaactgaaaacaggcctgcggaaaaagtcgttcagacatgcagcacttttgactgcgggggcaaatgcgatattcgggcgcatgtcagtgacggtatcgtgacgcgaatttcaacgcgaccggataacgcgctggatgcgcaaatgccggtgatgcgtgcctgtgttcgtggacgagcataccgtaaatttgtttatcatcctgacagacttaaatatcccatgaagcgcgtaggaaaacgcggtgaaggaaagttcgagcgaatttcctgggatgaagcgacaaccttaatcgccgataatttaaaatcgattactgaaaaatatggcccggcttcgcgctatgttcatgttggtaccgccgtttccggcggcaccttttccggcgataaaatggcgcgtcgcctgctgaatcttaccggcggctatctcgaaagctaccattcggtgagtatgggcaacacggtggccgcgacgccttatacttacggcattgccgccagcggcagttcgctggatacgcttttggacaccaaactggtgattctgtggggccataacccgacggagaccatttttggtcataccaactatttcttgcagaagatgaagcagaacggtacgcggtttatcgtggttgatccgcgctattccgacaccgtttcgtcgctggcggatcagtggatcccgctgctgcccaccaccgacaatgcgctgatggacgcgatgatgtacgtcatcatcagcgagaatctgtacgatcgtgcatttattgcgcgctacgctatcggttttgacgaagactcaatgccggaaggcgtaccggctaacgaatcgctggtggcatatctgaccggcgccaaagacggtgtcgttaagtctcccgagtgggcggaaaagatcacccatgtgccggcgcaaaccattcgccagttagcgcgtgattacgcgaagaccaaacctgccgcgttgattcaggggcggggccacagcgccacaactgcggcgagcgcaccgcgcgcggctcgactctactggcgaccattaccggtaatgtcggcatcaaaggcggttgggctgcgggttacggcggctgcgctaaccgtaaatttgccgcgggtccggagatgccggataacccggtaaaagccaaaatttcggtgatgaactgggtgcaggccgcagacgacgccagcaaagtgacgccggatatggggctgaaagatgccgataagctggacagtaacatccgtattctgttctcgctggccgggaactatctggcgaatcagaaccccgatctgcaccaggcggtacgcgtactggaggatgaatcaaagatccagtttattgtcgccagcgatctgtttatgacgccgagcgcgaaatacgccgatctactgctgccggaaaccagctttatggaacgttggaacatcggtgaaacttggggcacggcaagctacctgatactctctgaaaaactgatcgagcctgaatttgagcgtcgctccgactacgactggctacgtgaggtggcggcgaaattaggcattgagaatgaatttagccaggggcgcgatgagaaagcgtggattgaacacatctgggaacagacgcgcctggcgatgccggacgaaaatctgccggattttgccacactgcaaaagacccgtcagcatctgttcaaaagcgcgccatttatcgcctttgaagacaatattcgcgatccggacaatcatccgttcccgacgccgtcagggaaaatagaggtcttctcgaagcgcctgtacgacatgcagcatccggaaatcccggcgttgtcgcactacgttcccgcgcatgaaggcccggaggatgcgctggtgaaagattttccgctccagttaattacgtggaaaggaaaaaaccgcgccaactcaacgcaatacgctaacccgtggctgattgaagtgcagcagcagacattgtggatcaacccgcaggatgcgcaaacgcgcggcattacgcatggcgacatggtgcgcattcataactcacgcggaatttgcgaaatcccggcggaagtgacgccgcgcattattcccggcgttgtcgcgatgcaggctggcgcctggtggcagccggatgagaacggtattgataaaggcggctgcgcgaacgtcctcagctcggcccgtattaccgccctggcgaagggaaattcacatcaaaccatgctggtggaggtggcaaaagcatgagccagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggcggggtcagcaataacgtatttgcttatacgctttctatttcctgcaaccactgtgcggatcctgtctgcaccaaaaattgcccgactaccgctatgcataaacgcccaggtgacggcattgtgcgcgttgataccgacaaatgcgtcggctgtggctattgcgcctggtcctgcccttatggcgcgccgcagcttaacgagcagaccggccaaatgtccaagtgcgacatgtgcgttgatttactggcgaaaggtgaatcgcccggctgtgtcgcgacctgtccgctggaggccatcaagtttggcccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatgagttaccgctgctgatttttacgctctgtttgcaagggtccgtgggcgtgactctgtggctggcgctgggccgtcagtacgccgtagagggacgcgtacctgcgcgcggcgcgcttcccgcgatggcgggggcgtttgtactggcctgcgtggggctgcttgcttcagcgctgcacatgggctatcccctgaatgcgctaaacgcgttacgtcatgtcgccagttcgtggctgagtcgcgaaatcgtctttgccagcctttatctggcggcgctggggctgggggttgtgctgctgtttttccgaaagcctggctggcagccgctgctggcgctggcggcagcgttcgggctggtggatgtattctgcatggcgcaggtttatatccatgcctcggtggcgacctggcagcatagcaacacgctggcgctgttctttggcacgtcaggcattatcggctcggtagtcattgcgctggcttatctgcgcaacgctggcgccgcaatgcgctgcgctgtggtggtggtcgcactgatggtgctgattcgcctgatcatgcagccgctatggttggcggatattaatgcagtggatacgacggtcgtcactttcccgcatcatccgctacaggcgctggcgcagttgcgcgacatctatcttctcggctggtgtgtctcagcggcgggaatgctctgctttgccgcaggcggtctgcgaaacgccagagggacgctggtggcgggcagcgtattgctgcttatcggcgagattatgctgcgctacgtcttctttagtattggctgatggttaacctgacgatcgatccggcggtagacgtgacgcaggcctgcgtccgtcgtcgctttcgtttttcttcctgccgcgcttgcactgatgtttgtccggcgcaggtgttttcgctggcgcaggggcaggtcagcatagatacgacgcgctgcatagcctgtggcgactgtctgtttgtctgtcctgttgacgccattaccgatatcaaaccggttaaacgctttgtgcagggggatacgttggtggggccgttttcgctacaggcgccaacggtcgatgaactgcttctctggcacagccagtacggtattcgctttattgatattgcggtggagcgatcggcgcagtggctgatggcgttggcggggctaaatttagcgctgcgccgctacggcgagccgggctggtctttcaaacacgttgtcggcgcggaaattaatgcctcgcggcgcactctgtttcatgttccgcgcgacgccattaccccgtgcgccgtcgagccggggaaacggcgtctcagacaggcgttttccgcgttcagcgaatgcgtacccgaaatcagtccgcaagagtgcaggatgtgcggcgcctgctggcgaagctgcccggaaaacgttatccagtttgacgacgacacgctgacgatagcggcggcgcgttgtacgggatgcggcggctgtgcggcggtatgtccgcatcaggcgctgcggctgcggtttgacgtggaacccgcctcaacgcggcatagtgcggtgcatacgctcacctgcgaaagctgcaaacgtactttccatgctctcacgcctgaacacacgcactgcgtgctgtgtcagtcccctgagtttgctgtgcgcctttaacttttgttgctaatgctcattttattttaaaaaaatgttacctgcatccataggcaattgatgggatgctctttataatccgcgcctgacataacaacagaacatatttcagaggtaaacatggctattgaacggactttttccatcattaaacccaacgcggtggcaaaaaacgttattggcagcatctttgcgcgctttgaagctgcagggttcaaaattgttggcactaaaatgctgcacctgaccgttgagcaggcgcgcggcttctatgctgagcacgacggcaagccgttctttgacggtctggtggagttcatgacctctggccctatcgtggtatccgtgctggaaagtgaaaatgcggtacagcgtcatcgcgatctgcttggtgccaccaatccggcgaacgcgttggcggggacgctgcgtgctgattacgctgacagcctgaccgaaaatggcacccacggttcggattcgctggaatccgcgcagcgcgaaatcgcctttttcttcggtgaaggcgaagtgtgcccgcgcacccgttaatctccttcgtctttcacgctgtaaatgcgttggcgataaattatcggttcaaatattatttttgctaatgccgcgtgcagacgtggcatccttacgccagaatttgtacaatgcagcgcccccggacgagcagtaagcttaccggggcgtttcttttttcaaccctccaggggccataacgtgtaataacgaggccggaatagcatatgtctgaacaaattgtcacacctgaaagcagtaccccggtagttcttaacaacgaaacaaaaatcaacctgctggatctaaaccgtcagcagatgcgcgagttttttaaaaacttaggtgaaaaacctttccgcgccgatcaggtgatgaaatggatgtatcactattgctgcgataattttgatgagatgaccgacatcaacaaagtgttgcgcggcaaattaaaagaggtcgcggaaattcgcgcgccggaggtcgttgaagagcagcgttcttcagacggcaccatcaagtgggcgattgctgtcggcgatcagcgcgttgaaacggtctacatcccggaggacgaccgcgctacgctgtgtgtctcttcacaggtagggtgcgcgctggagtgcaaattttgttcaactgcgcagcagggctttaaccgcaacctgcgcgtatcggaaattatcggtcaggtctggcgtgcggcgaaaatcgtcggcgcggccaaagtcaccggccagcgtccgatcaccaacgtagtcatgatgggaatgggcgagccattgcttaacctgaccaatgtcgtaccggcgatggaaattatgctcgatgactttggtttcggcctgtccaaacgtcgtgtcacgctctcaacgtccggcgtggtgcctgcgctggataaactgggcgatatgatagacgtcgcgctggctatctccttacatgcgccgaatgacactattcgcgacgaaatcgtcccgatcaacaaaaaatataatatcgaaacgttcctgggcgcggttcgccgctatctggagaaatccaacgccaatcaggggcgcgtgacgattgaatacgtgatgcttgaccacgttaacgacggcactgaacacgcgcatcaactggcggagctactaaaagagacgccttgtaagattaatctgattccgtggaacccgttccctggcgcgccgtatggccgcagctctaacagccgtatcgatcgcttttctaaagttttgatgagttatggtttcacgaccatcgtacgcaagacgcgtggcgatgacattgatgcggcatgcggacagttggcaggcgatgtgattgaccggactaaacgtactctgcgtaagcgtatgcagggagaggtgattgacatcaaggctatttgatagcagttgcgccacggggcattcattataccgtggcgcaatgtcagttgaataatgtctggcgttgtacttgtctggtcaataataacggtgcgtttttgtcgactttaaggcagtatgtaacgatgcaacaagagtttaaccttgtgtcttaagcggttttgtcatctgcggcctgacaggcttatactgtctgactaaaggttaactaacctgatgtttcgcggtgtgggcgggcattacggctcgtcggcgcctgaatcctaatttacacgtacctgtagctgtagcgaatgaatactgaagccacgcacgaccaaaatgaagcacaaaccaccggcgttcgtctgcgcaatgcccgtgaacaactcggactcagccagcaggctgtcgctgagcgactttgcctgaaggtttctacggtacgcgatattgaagaagataaggcgccgtccgatcttgcttcaaccttcctgcgcggatatatccgctcatatgcgcgtctggtgcatgttccagaagaggaactgctgccggggctggaaaaacaagctccgctgcgcgccgctaaagtcgccccgatgcagagtttctcattaggaaagcgtcgtaaaaaacgcgacggctggttaatgtcttttacctggctggtactgtttgtggtcgtagggctgaccggcgcctggtggtggcagaaccacaaggcgcagcaggaagagatcacgacaatggccgatcaaagcacggctgaactgaacgcagataaagacagcggccaaagcgtaccgctggacaccagtgccgcgacaagccaggatacgacgccagcgcaaacggctccggctcctgcgacgccggttgattcgacggcggcaacgcaaaatacggtagtcgcgccttcgcaggcgaatgtcgatacggctgcgacatctgccgcgccagcggcaacggaaacgccgtccgcgctgccgaccagtcaggctggcgtagcggcgcctgctgccgatccgaacgcgctggtgatgaattttaccgctgactgttggctcgaagtcactgacgccacgggtaaaaaactgtttagcggtatgcagcgtaaagatggcaatttaaacctaaccggtcaggcgccttataaacttaaaattggcgcgccggccgcggtgcagatccagtatcaaggaaaacctgtcgatctgagccgctttatcagaactaatcaggttgcgcgtctgacccttaatgccgaaccgacaccggcgcagtaacagacgggtaacgcgggagatttttcatgcataaccaggctccgattcaacgtagaaaatcgacacgtatttacgttgggaatgtgccgattggcgatggcgcccctatcgccgtccagtcgatgactaacacgcgtaccactgacgtggaagcgacggttaatcagatcaaagcgctggagcgcgttggcgcagatattgttcgtgtttctgtaccgaccatggacgccgccgaagcgttcaagcttatcaaacagcaggttagcgtcccgctggttgccgatattcacttcgactaccgcattgcgctgaaagtagcggaatacggcgttgactgcttgcgtattaaccccggcaatatcggtaacgaagaacgcattcgcatggtggtggactgcgcgcgcgacaaaaacatccctatccgtatcggcgtaaatgccggatcgctggaaaaagatctgcaggaaaaatacggagagccgacgccgcaggcgctgctggaatcagccatgcgccatgtcgatcatctcgatcgtctcaactttgatcagttcaaagtgagcgtaaaagcgtccgatgtattccttgccgttgagtcttatcgtttgttggctaaacagatcgatcagccgctgcatctggggatcaccgaagcgggcggcgcgcgtagcggggcggttaagtcggcgatcggtttaggtctgctgttatcggaaggcatcggcgacacgctgcgcgtatcgttggcggccgacccggtggaagagatcaaagtcggtttcgatatcctgaagtcgctgcgtattcgcgcgcgcggcatcaatttcatcgcctgcccgacctgttctcgtcaggagttcgacgttatcggcacggtgaacgcgctggagcagcgtctggaagatatcatcaccccgatggacgtctcgatcatcggttgtgtggtgaacgggccgggcgaagcgctggtatcgacgctgggcgtgacgggcggcaataagaaaagcggcctgtatgaagacggcgtgcgtaaggacagactcgataacgacgatatgatcgcgcagcttgaatcccgtattcgcgcgaaagtaagtcaacttgatgaagcgcgtcggattgacgtgctgcaggttgaaaaataagaacgtgatgggaagcggcgcgcttcccgtgtatgattgaacccgcatggctcccggttcgttcggggaagcgctgagggttcatttttatattcagaaagagaataaacgtggcaaaaaacattcaagccattcgcggcatgaacgattatctgcctggcgaaaccgccatctggcagcgcattgaaggcacactcaaaaacgtgctcggcagctacggttacagtgaaatccgcttgccgattgtagagcagaccccgttattcaaacgcgcgatcggtgaagttactgacgtggttgaaaaagagatgtacacctttgaggatcgcaacggcgatagcctgacattgcgccctgaaggtacggcgggctgtgtacgcgccggcatcgaacatggtctcctgtacaatcaggaacagcgtttgtggtatatcgggccgatgttccgtcatgagcgtccgcaaaaaggccgctaccgtcagttccatcagctaggcgccgaagtctttggcttacaaggcccggatatcgacgcggaactgattatgctgaccgcacgctggtggcgcgcgctgggcatctctgaacacgttagcctggagctgaactctattggttccttagaggcgcgtgcgaactatcgcgatgcgctggtcgcgttcctcgaacagcatcaagagacgctggacgaagactgcaaacgccgtatgtataccaatccgctacgcgtgctggattcaaaaaatccggacgtgcaggcgctgctcaacgacgcgcctgttctcggcgactatctcgatgacgattcacgcgagcactttgccggcctgtgtaaattgctggacgcggcggggattgcctacaccgtcaaccagcgtctggtacgcggtctggattactacaaccgcaccgtatttgaatgggtaacaaacagtctggggtcacaaggcaccgtctgtgcgggtggtcgttatgatggtctggtggaacaactgggcggtcgcgctaccccggcagtgggctttgcgatgggcctggaacgacttgttttgttagttcaggcagttaatccggaatttattgcctctcctgttgtcgatatatacctggtagctgccggcgcacaaacgcagtctgcggcaatgacgctggcggagcggctgcgcgatgaaatgccaggcgtgaagctaatgacaaaccacggcggcggcaactttaagaaacagtttgcccgcgccgataagtggggcgcccgtattgcactggttcttggcgaatctgaagtcgccgatgggactgttgtagtgaaggatttgcgctccggtgagcaaacggcagtggcgcaggacagcgtcgccgcgcatttgcgcactttattgggctaaggagaaggacagcgtggaaatttacgagaacgaacacgaccaggtggatgcgattaaacgcttctttgccgaaaacggcaaagcgctggctgtcggagtgattttaggggttggcgcgctggttggctggcgttactggagcagccatcagacggagtccgcgcgtgctgcttctctggcgtatcaaaatgcggtgacggcggtaagcgccgataagccggatagcattcccgccgctgaaaaattcgcggctgagaataaaaatacctatggtgcgctggcgtctatggaactggcgcagcagtttgtggataagaatgaacttaaaaaagccgaagcccagttgcagcaggggttggcggccaccagcgatgaaaatctcaaagcggtgattaatctgcgtctcgctcgcgttcagttacagcttaagcaagctgacgccgcgctgaaaactctggatgccgttaaaggcgaaggatggacggcaattgtcgctgatttgcgcggcgaagcgttgctgagtaagggtgataaaaaaggcgcgcgcagcgcatgggaagcgggcgtcaatagcgatgcttctccggcgttgagcgaaatgatgcagatgaaaatcaataatttgtccatctgagagggacccgatgcaattgcgtaaattacttctgccagggttgctttccgttaccctgctcagcggctgttcactgtttagcggcgaagaagatgtcgtcaagatgtctccattaccgcaggttgaaaaccagtttaccccgaccactgtctggagcacctctgtcggtaacggaattggtgaattttattctaaccttcatccggtaatggcagataacgtggtctatgcagccgatcgcgcgggcgtggtaaaagcgctcaatgcggatgatggcaaagagatctggtctgtgaatctgggcgagaaagacggctggttctctcgttcgtccgcgctgttgtccggcggcgtcactgtcgcgggcggtcacgtctatatcggcagtgaaaaggccgaggtttatgcgctgaataccagcgacggtaccacagcatggcagacgaaggtcgcaggcgaagcgttgtctcgcccggttgtcagtgatggaatcgtccttatccataccagcaacggtcagttgcaggcgctaaatcaggcggatggcgccattaaatggacggtgaacctggatatgccttcgctgtcgctgcgcggcgaatctgcgccggcaaccgcgttcggcgcggctatcgttggtggtgataatggccgcgtcagcgccgtgttgatgcaacaagggcagatgatttggcagcagcgtatctcccaggccactggcccaacggaaattgaccgtctgagcgacgtcgataccacgccggttgtggtaaacggcgtcgtttacgcgttggcgtataatggtaacttaacggcgctggatctgcgcagtggtcagattatgtggaaacgcgagctggggtcggtcaatgactttatcgtcgacggcgaccgtatctacctggtcgatcagaacgatcgtgtgctggcgctgaccactgacggcggcgtaacgctgtggacgcaaagcgatctgctgcaccgtttgctgacctccccggtactgtataatggtgatttagtcgtcggcgatagcgaaggttatctgcactggattaatgtcgatgacgggcgttttgtggcccaacaaaaagtagacagttccggttttctgaccgaaccgacggtggcggatggtaaactgctcatccaggccaaagacggtacggtctacgcgattacgcgttaatcgtcacggttgtgcgtttgaaaaaacggctcctggtgtaggggccgttttcctgtttttaacaacggcgtaaaaatgacgcgcgttgtctgatgattttttaaatgaggctttaaacatggtacctgtggtcgcgcttgtcgggcgccctaacgtcggaaaatccacgctatttaaccgtctgacccgcacccgagatgcgttggttgcggatttcccgggtctgactcgtgaccgtaagtacggtcgtgcggaggttgaaggccgcgagtttatctgtatcgacaccggcggtattgacggcaccgaagacggcgtcgaaacgcggatggcggaacagtcgctgctggcgattgaagaagcggatgtggtgttattcatggtagatgcgcgcgctggtctgatgccggcggatgaagcgattgccaaacatctgcgctcccgtgaaaaaccgaccttcctggtggcgaataaaacggatggtctcgatcccgatcaggcggttgtcgatttttactcgctgggattaggcgaaatttatcctatcgccgcctcacatggtcgcggcgtattgagcctgctggaacatgtgcttctgccgtggatggatgatgtcgcaccgcaggaagaagtggatgaagacgcggaatactgggcgcagttcgaggcggaacaaaatggcgaagaagcgccggaagatgattttgacccgcaaagcctgccgataaagctagcgattgtcggtcgcccgaacgtaggtaagtccacactcactaaccgtattctcggcgaagagcgcgtggtggtatacgacatgccgggcaccactcgcgacagtatttatatcccgatggaacgcgacgaacgggaatatgtgctgattgacacggcgggggtgcgtaagcgcggaaaaatcaccgatgcggtagaaaagttctcggtgattaaaacgttacaggcgattgaagacgctaacgtcgtactgttggttatcgatgcgcgcgaggggatctctgaccaggatttgtctctgctgggctttatcctcaatagtgggcgctcactcgttatcgtagtcaacaaatgggatggcctgagccaggaagtcaaagagcaggtgaaagagacgctggatttccgtctgggctttattgattttgcccgcgtgcactttatctctgcgctgcacggcagcggtgtcgggaacctgtttgagtccgtacgcgaggcttacgacagttccactcgccgggtgagcactgcgatgctgacccgtatcatgacgatggcggtggaagatcatcagccgccgctagtgcgcggtcgccgtgtgaagctgaaatatgcccacactggcggctataacccgccgattgtggttattcacggcaaccaggtaaaagatctgccagactcctataagcgctatctgatgaactacttccgcaagtcgttggaagtgatgggtacgccgattcgcattcagtttaaagaaggggagaacccgtatgcgaacaagcgtaacacactgacgccaacgcaaatgcgcaaacgtaagcgtctgatgaagcatatcaagaaaagcaagtaatgctttttcagtaatattccaggcctgataagcgcagcgctatcaggcctttcaagtaaaagcgagtcacgcgcctgaggagaatgttatggaaataatctgccctgtttgccatcatgcgctggagcgcaatggcgatacagcccattgcgagacatgcgctaaggatttctcgttacaggcactttgtcctgactgccgccagccgttacaggttttgaaagcctgcggcgcagtggactatttttgccagaacggtcatggtttaatttcaaaaaaacgggttaatttcgtcatttccgatcaataaaaccactgtcgacgttgcgtcgcagagcagaggcgccgacgtcttatccggctaagggcaaaagcgttattctatactcccgtaatatcagcatagtaccctgcccggcggttattttattctttttatcgattcaactatttatagggaatattattcccgaaaattaatattagaaataaataacagctttccttttatttattatatcaatattataagtctgtttcatattaaacttttctttttaggaatatatttaggcctgttagttatgattccctatgaatcatccatataatatcgtctcatagcagcgtgtttatttaacaacagggatatcatatggtgcgaaggattcgcattctggttttgctattagtgtctggagtatcagttgcggcttccggcgcaggtaactctgtacctgcaaacgatgaaagccactcctccctgcctgatttagccagcgaatccgcgaaaaaagaagaacaggaaaataaaggaaagtcctttaaagaacagggcgctgactactttattaattccgccacccagggctttgataatctcaccccggaagcgctggaatcctaggcgcgtagctatttgcaaaaccaaatcacttcatcagcacagtcatatcttgaaggcgtaatgtcaccttatggcaagatccgtaccagcctctccgtaggcgaaggcggcgatctggacggcagttcgctggattatttcgttccctggtatgataacgaaaaaaccttactttttagccaactctcagcccaacgtaaagaagaccgcactattggtaactttgggcttggcgtgcgccagaacgtcggcaactggctgcttggcggcaacgcattctatgactacgattttacgcgcggtcaccgtcgactaggtctgggaaccgaagcctggacggattacctgaaattctccggcaactattaccatcctctttctgactggaaggattccgaagatttcgacttttatgaagaacgacccgcgcgcggttgggatatccgcatggaaagctggctgcccttttatccgcagcttggcgctaaattagtttacgaacagtactacggcgatgaagtggcgctgtttggcaccgataatctgcaaaaagatcctcatgccgttaccttggggctggaatatacgccggtaccgctggttacggttggttcggattacaaagccggtactggcgataataacgattttagcgttaaagcgactgtgaactaccagataggaacgccgctggcggcgcaactcgatccggaaaacgttaaaatccagcactctttaatgggcagccgcaccgattttgtcgatcgtaacaatttcatcattctcgaataccgcgagaaagatccgctggacgtcacgttgtggctgaaggccgacgccaccaacgaacacccggaatgcgtgattgaagatacgcctgaggccgcggtggggctggagaaatgtaagtggacggtcaacgcgctgattaaccatcattacaaaattatttctgcttcctggcaggcgaaaaacaacgccgcccgtactctggtgatgccggtggtaaaagcggatgcgctgaccgaaggcaacaataacagctggaatctggtgcttcctgcctgggttaacgccgataccgaggcgcagcgcaccgccctgaacacctggaaagtacgcatgacgctggaagacgaaaagggcaataagcagaactccggcgtggtggaaatcaccgtccagcaggatcgcaaaattgagctgatcgtcgacaacattgccgataacgatcgcagcgatcacagccatgaagccagcgcgctggccgatggcgaagacggcgtggtgatggatctcctgatcaccgactcctttggcgactccacggatcgcaatggtaacgaactggtggacgatgctatgacgcccgtgttgtacgacagcaatgataaaaaagtcacgctggcccagacgccctgcaccacggaaaccccctgcgtgtttattgccagccgtgacaaagaagcggggacggtgacgctttccagcaccctgccgggcactttccgctggaaggcgaaagaagacgcctatggcgacagtaactacgttgatgtcacttttatcggcgacaacctgagcgcgctgaatgcggtgatttatcaggtcaaagccgccaaccctgtcaacctgatcggcaaagaagataaacatcctacggttaataacacctaccgtttcctgctgtggcgcgacaagaataaagacggcgtattccagatgtccgagcagctcacggaagaagagatggccctgtacgactaccagtgggagtttaccggacagagtacaaacggacataccggcgcgctggccaacaccataaatgaagatcttgttctgccagtaaccaataaagaggcggcgcagaagtttgccgccaatgtggaagatggcgttcagggttacggtatacgcgttacgtatagtcagaaatagcgtcagcgttatggctgaccagccagccgctgaattttgagaaaaaagagagtctgaatgcaagcaacagtaaaacggcggctgacgaaggtcgctttagcattagtagttgccgggtattgcgccgcgccagcggtggcggcaaacggtaatctgaaatcggggcagtggcagattgtctctgaacagacgggcaccattcagggtacggtgccgtggattacccgtgcggcggataagaccgcggataccgacaaagatcacgtaacggtaactatcgatcgcggcgatcgtaaaattgtgaccgaaggcgataagcagttccacgttggcgataaggtcacggtcaactgggcgattggcgatacggaaggcgacctggatgtcgacaacgccgccacgaaactgacggtgcagtggatgagatacagcgaccagaatggtagcaatcccgaagagattggcgccaaaggcagcgatacctatgaaattcaggcgggtgacgcagaccattatatcggtatcaaaatcacgccaaccaccaccaccggtgaccctgccgtggcaaccgaactgctgttgaaagacctgtcgaccgatgcgggcggtggtgcggatggcgacgacattccggaaggtccggtggtggatgaaaacgtccatgtggttattcatgagaaagattcgaataccaacctgttgaagaattcagggacgacactcaaaacgaatactacctatcaggtattgctgtggagcgataagaacggcaacggcacctatgatgccggtgaaaacgttaccgaccagtatgactaccgctggaaattcgtcggcaccagtaaaattgcaggtaccggtactggtggtatcgtcaacgaaaactggaacgataaagaccttgtcatcccgcttaccaacgccgaagcgaaagaggcgttcgagggtgcggaaggcggcgttaccgtgggtagcgacggtgtccagggctttggtctgtccatcgactacaaacgcaaataagttgtcctcaacataccactccccgcggggagtggtattttccgcgcactttgcttagccgcgcgctaagcaaagtgggttgaattacgacagagaatgaaaacgggtggctatcgctcatggacaggaatcggcaagtgaataaagttgtacatttcttactgacattactgatcatgtttgtagcgtcgatcgcgcctgcgcaggccttactgaaaggcgggacctggcaagaattgaactcagccactgccgcagttaacggcaccgtgccccgcgccgacggcgcgattattcccgtgtatcagggaagtatgctgcttgacccgaccaaaacctacgatgttgcgtttaccgccatgccgcgcgattttagcgcggatgccacctcaacctcgatgcgtgcggtcaattccaccgataccgaaggcgatctctttagcgatccgccgaccattgcctgggaaaatcaacagccgccgagcgtgggcctgttatgggccgatgccgccacgcccgacacgccgctttcgccgcagccgacgcctaaccagaccttttgcgcccagaacctggccggacggaaactggttgtctggccgcagccagacgatgaaacgaccgtccccgcgctgtggctctatactcacaccggcgtgccgaataatgcggccatcccgctgctcagcccgaaagtgactgtcaatattgcccaggcagtaggcaatcccgtgtcggtcagcggcgatcatgttgatgccagctttaaagcctcaaaagtgaaagtaggagagagcatcaccctcaccgtcacgaccagagggtgtgatggcaaactggtgaaaaatgcgccgtttgtcatccgccgtgaggatgccaaaaaccgtcagggtgtggtcaataacactaacccggtgcacgttggcgatgccgagctaacgaccgtgcaaacggagtatcgcggcgtcaccgatgccgagggtaaagccactgtggtggtgacgcaggatgaaggccccggcgtaaaaacgcatcttatcgtcgcttcgcaaagttatcctacgctgacggacggcgtggacgttattttcaccaccatcaccagccccgacaccgcccaggccaacatgtacggccacatgctggagagcgccagcgccacgctgaacggcgcgacctacactttcactcgaccgaagctggcggtggaggcgggtaacgctgacgaaagcgtcaacgatactaacgaaacctgggcgcagtttacctggagcggcgcggataaccattgcgacgttctgccggacgccgaacaactggtggcgctaagacatgcgcatagtacgctggcaacgtacaccggctggccggcgtcgggcgatgcggaatactggtcgtcaaccaaagatcagatgaacaactaccacgctgccgtgcatatgaacagcgcgtcggtcgtcagagcgcccaacagcgatacgctgctggttagctgtgtggataaagcccagcctgcggcgcacccgcagattaccctctctccggaggggccttataaggcgcaggtgggggaatcgattgatctggtcatgacggtagtcgataaagacacgcaaaaaccgctgccttaccgttacatggagctgtttatcgacccggcgaaaaaccgcaaaggggagcatcaggacgcgtgggataaccagcgggttaccgtcagctccgaagatatgcgcgcctcttcgccggaacactataccggcgtgaccgacgtcaacggtcaggcgcacctgacgctacagcacgacagcggcatggggggcgagacgcccatccgcatcgtgatgccggacgatgaaggcggcaacgtcgagctgccctttagcgtcattttcaccgtaataaccagcccggatgtggacggcgccaacatgtggggccatatgcgcggcgtggtggatgccggcaacctgtataaacgcccgctgctggcggtggaagccagccataaagacggtcagttcagcgaaaacaacgaagagtgggcgacgtttaactccgtggcgtcggccaccgcgcagtgcggcgtcggccaggtgccggatcagtcatcgctggcgcatttatacagcgagcaccccagcggcaagatggaaatcgaacacggctggccgaccgaagactacttcatcgccgcggatagcgacgcctcgggaacggtacacgtcaacctggcaaacggcgacagcaacaaatttaccaatcagccgaactacctgacctgctcggccaatgaaatggtggcggtgctggacgtctacttcaacgacgacccaacgactaaaaatgctgatatgaccgccaaagtcggcgaacagattaagctgaatattcattcgcgcaacgcccttaacgacatggcgattgcctataccgacttcaccatcaccatggcgaacggcaagcggcgcgacggattgacgaccggctttaccgatcccagcaacggcgagatgcagtttgacggcgtgggctaccttgccgggcaggtttatcacgggatcaccgacgccaacggcgatgcgaccattatcctcacccagaataagggcgtggggctactgacgccgttaagcatcgcgcccgtcgattcattaatcaagacgccgatttcccgcagcgtcaagtttaccgtcgccaccagcccggacacggtaaaagccaaaatgtggggccacatggccgacactcttaccgtcggcgactggacttttgagcggcctaagcttgcgagtgaagtaaatagcccgctgcgtactcaggaagagagcaatgaaacctggacgcgcgtggcccatatcgacgcggcgggcaacccggatgcgggcggctgcgcggcgaaccgcctgccgcgtatcgaccagcttgaggcgttatacagcgccaacagcggcggcgcgatgaaaaagactcagggctggccaaccttaattaactactggtcgtccacctaccagagcgccaccacctggaaactgatcgcgctggcgagcggcagtgaatttccgggcagcaacacctcggtttacaccagttgtctggccagcgataacccggtgccagccgccatcaccattgaaccggtcgatccgtcgcagtggtacgacggcagtggcgtccatgcgctgaaagtgaaaaagggcgataccctacagttgaaggtgacggtgaaggacgccagcggcaaaccggtgccggaagcgccgtttgtgctcacccgcggcgacggctacgatcgcaaaggggaaaagtacaccgcccaggacggctccgatttgcaaaatatcgtgacgcccgtggtgatcgacggcgaatcgctggcctggactaccaccaaaatggggtcgcagaccggccctgatggcacccgcatcatcagcgtcacccgcccggacacccacggcacccgcacggccattaccgccacgctgtatgaaaatgtcgccgtgagcgccagcatcgacaccatctttaccgtcgtcaccagcccggatgtcagcgtcgcccgcatgtgggggcatatgacgccgtcgctgacggctgcggatagcgcggtgtacaagcgcccgctgctctacgatgaactggccagcaagaccggtgctgcggagtacccggaagacaacgaacgctgggtggtgttctatgggccgaatacgaccaaaaccgttagtccggaagcttgctccaaggggtatttcccgtccgttgagcaactggattctctgtacagcaaatacccgaacggagcgataaaaaccgcccagggctggccgatcatccgttcttactggagcggcacaaacgccgggacaatcacccccggcgcgccaccctatgactattacacggtcgatctgaatgatgatgcgcaccggaaggttcccaatattagtgatagcgacaggcaataccagatttgcgccgcgacgccgcagcctctggccgggcggattaccctcacttctacgctggcgacggatagcgatatccaggcggtgaaggcaaaaaacagcgactcgattccgctggtgatcaccaccaccgatgcggcgggcaacccggtgccttatacgccattttccctcatacgcgacgccgggacggcgcgcaacaccagctatacctttaccggcagcactaacatgatgctggcgccgcccaccggttcggcgcaacagttctactataatggctacactatttacggtgccaccggcgcggacggcacggcggtcctcacgctgacgcaggccgcagggccgggggtgaaaaacgtgataaccgcagccctgaccgacacgccgacggtaacctcgacgctgccggtggtgttcaccaccgtgaccagcccggacagcccgcaggccaatatgtatggccatatgccggaaaccttcaccgccagcaacggcgcggagtttaagcgcccgctgctgtatagcgagctggcgtcgacgttaggtgtgaagagctatgccgacacaaatgaaaactggcctatagtgaataattttgataccagtaattatggcgcctgttcgataaatcagatggccacgctggatgatctcaaggcgctgtacggcgatcaccccagcggcaaggtcacgaccgacataggcttacccgtcaggaagaaatggtgggcgggcgacagcctgctgcaaggtcaagtcatatactggcgatatatcgatctcagtacgggcatagattactccatgtcgggaacgccgggtaattactattaccagctctgcctgaccaaaccgcgccagatgaatatcgcgctctctacggacgcctggaacgcggacaaatcggcggccgtggcgaaaaaaggcgaaacgatccccatgacggtgaaggtgacgaacgctgccgggcagcctgttagcaacgcgacggtgaaaatcacgcgcggcgatgcgctgacgcgtgcggggagcgtgtataccaccaacaacgcggacgatattaccttaagtaatatccagccttccggtacggcgacgtacttgctggggtcggtggataaatatatgtatgcgcaaacggacgcccaggggcaaataacgtttagcgtgtcgcaaaataatactatgggtcttaaaacgcccatccgcgtcaccgttgcgaatgacattaccgcaacgagcagtaaggacgtgatatttaccgtccttaccagcccggacgtcgccagcgccaactactgggggcatatgccggaaaccgtggaagggccggacggcctccgctaccagcgcccgcatttgcaggcggaagcgccgtcgggcgtcaactacatcaccgtgaacggtgaaaaatgggcggcgccgaccggcgtacagacgtatacggcaggccagtctgcgtgcgacgttgagtatatgccgctgatgaatgacttaaaggcgctacagcaactgtatcctgacggcgcgctggaggatcaattcggctggccggtgaaaaccggtaaactctggtggtctgccgatctgaatagctcgaaagcacaccaggcgataaacctgaaaaccggtcagatatcggcgccaacctccaccagcttgcaggcctgtttggtcaatgcgcgtaatgtccctgcctccattacgctaacctcgacggcgatggatgcggagaaaggcgcggcggtggcgaaaaaaggcgaggctattcccttgacggtgacggtgaaaaaccgcgcgggcgttcccatagcgaatgaaccgtttaccctgaaacggggcgatgcgaatgatcgcctcgacattaaatatacgtggaatactacagcagacgatttgacgttgcaggaactgacgccgtcgccgacaacgaaatcaatgacggcttccggcaatgtgtttagcggcgtcacgggggctgacgggacggcaacgtttacggtgaaccaggacggcagtgtggggctaaaaaccgagctgacggccagcgcgacgggggatgtcacgcaatcaaccaacacagcgctgggcgtgatctttaacgtgattaccagcccggataccgataaagcgcagtactgggggcatatgccggatacgctgacggttggtggcgtgacgctgcatcgccccttgttgatgaaagaagcgcctgctggcgcgacggatagccggaaagaaaataacgaaacctgggtttcggtttatacgaaagccgatggtcttacctatgatatgagcaagaactgtggcggggtggccgggttcccggcaaaaggcgtgctggaaaaaatacgcgatgagcagatggcggtcgctaacggatggccgacagtttcgttgccttacgctagcagtacgcctgggacgtataattattgctgggtttcgttagcgaaagggggcacaacacattgcccgaccaccagcagcgattactcgataggctatgccgcctgtcttgtacagccgtgatcgggatggttgggtttcggtaaattgtcgttggtaccggtagtgaaacgtttcgcatttttaccgccgatggaatgaatagtcagaaagggatgtattccaggtgctgcattgaaactgaaaacgaatacccatcttttatccgggctacaggcatgtctgttttgtgttaccgctttttttgcccaggcggcgcaaagcagcgccccatggcaggagcctgacgtctcaactgccgccattaacggcacgccgccgctggctgacggcgtgacgatcccggtttatcagggcagcgttcagttgcgatctgatgcagcgaatcccgtcgattattccgcgaaacccagccagttcagcaccagtgatgtcggcagcgcgctgaccttaaccaatccgcgcgatgccgaaggcgatattttcgccgagccgccgctggtctggcagagtgaacggataccctccgtcacgctggtatgggccgacgccgccacgccggagacgccgctgtctccacaatcgtcggcaaacctgacgttctgtgagcaaaatatggcaggccgccatctggtagtctggtcgcaactggatacctcaaccgctatgccgccgctgtggttgcttacccgcaccggcgtgccttataacacggcggtcgaagtgcttgaacaaaagtttgccgtggatatcgcgcccgccgtgggtgacccggtaacccttaccgccgatcatctggatgagtcgcttaacgccgcgaaggtgaaagcgggcgaaagcatcacgctgacggtgaataccaaaggttgtaacggtgagccagcgggcaatatcgcgtttgtgattacccgcggcgatgcgcaaaaccgccagggcgtggtgaacaataccgcgccggtacgcgtcggcaacaccgaactcaccaccactgccaccgaataccacggcacgaccaacgcggaaggggtggcgacggtgaccgtcacccaggctaacgggccgggcgttaaaaccccgctgatggcgcacccgtcgaacgcgcctgcgctgaaagccagcgcggatgtgatttttaccaccctcaccagcccggacagcagcagcgccaacatgtacggccatatggcggacagttccaccgccacggtggacggcgcaagctacacttttgaccgccccaaactggcggcggaaaccgagggcgaagaccgcgtcgccagtatcaataatgaaaactgggcgcagttcacctggggccatgcggataaacactgcgatattctgccggatgcgcgccaactggaagggttaaaaatcgagcgcggcgatttagccaccactctcggctggccggtggggtgacatccggtgacgaagagcactggtcctcctcacagggggcgagcgcaactgaccacatcagcattgatatgcgcagccgcgcccttacgcagatgccggacgccacgcaatcgctggtgagctgtgtggataaagcctcgcctgcggtcacgccgaaattagtgattagcaccgataattttgattcgacggccaacgcggcgaaagtgaaggtgggcgaagagatcaacatgaagatcgccgtcaccgacagcgccaccaataaaccgctgccttatcgctactttaatgtctacctgggcgacgagcaaaatcgccagaatcagaagaacgccgatcttgatgccgcgcatcagtggacggatgaaccggtagttatcgccaatctggacggcggcgacggtcactatcacggcgtcaccgacgccaacggccagttttcgctggcgctgacccaggacaagggcgctggcgtattaaccccggtgcgcgtggtgctgttcgacggcacggaagcgacgcagaatgtgatttttaccgtcgtcaccagcccggacgtgacgcaggcccgtatgtggggccatatgcagggcgtggtggaagcgggcaatatttacaaacgtccgctgctggcggaagaggccgcgcaggataccggttccgaatttgagaataacgagtactgggccacgtttaactcagtgacggcagcgacaaaccagtgcggcgcaggccaggtgccgggacaactgctgctggatacgctgtatgaagcccattccggcaatacgatggaaacgacttacggctggccgacacagaaacatagctatattgcggcggataccgatggttccaccactgcgcacgttaacctggcgaccggcgcggacagcctgttcagcggcgctgaaccgaactatctctcctgctccggtaacgagttggtgaccagcctggacgtgtactttgatggcaacgagtcgttacgtaatgcggtagccaaagtgggcgaaaaaattacgatgaacgtccattccgtcaacgcgctgaacgggttaagcgtgcccaacgccagctttaccgtcaccatgtcgcacggtaaaaatcgcgccaacgccaccacgggctttaccgatcccagcgacggaacgctggtgatgggcggaacgtctttcggctcttccctggcgtcgatgacgtaccagggcatgaccgatgccgcaggcaacgccacgctggtcattgaacaaccgcagggtgtcggcttgctgacgccgctgaccgtactgccggttaactcgctgatcaccacccccgttaaccgcagcgtgaagtttaccgttcccaccagccccgatacgccggatgcgcaaatgtggggccatatgtccgacgccatcacggtgggcgatatgacctttgagcgaccgaaactggcggcggaggttgccgcgacccgcacccaaaccgaggccaacgagagctgggcgcgcgctacccatgccgatgcggtaggcaatacggcggcgggcggctgcgccgctaaccgattgccgcgcgccgatcaactggaggcgctttacgccgctaaccgcgacggggctatcaatagcacgcacggctggccggtgctgattaattactggacctccacctggcaaagcgccacaacgtggaaactgatagcgctttctaacggtagcgaatttccgggcggcgctggcgcatccgattacgtcagttgccttgccagcgataacccgacggcagcctccatcaccattgagccggtgaatacgtcattgtggtatgacgagaacagcgaacacgcggtgaaggtgaaaaagggagatacgctccagcttaaagtgacggtaaaagacgccagcggcaatccgctgccgcaagcgccgttcgtgctcagccgcggcgacggcatcgtctcggcggtagtgattgacggcgattcgctcaacgacaccgccaccaaaatcggcggcatgaccggtgaaaacggcagcaaaatcatcaacgtcacccgcccggatgcccacgggacgaaagtcgcgattacggcggcgctgtacgataacgccagcgcgacggccagcatcgacactatttttactgtggtcaccagccctaatagcgacaaagccaaaatgtggggccatatgccggaaacgaccacggcggccaacggcgtggtgtttaagcgcccgctgttatcggctgaaatcgccagcggctttacccacggcgacaatacggaaaacaacgaagcctggggaatcgtcgattttgaagtggcgaacgacgcctgtggcgcgggatacgtaccgacacttgccgatctgcaatcgctgtacgacgccaggcccggcggcaccatgaatacgcagcagggctggccgctggatggtaaaaactaccagaacagcaccgctgatttgagcaggagtacggaaaaccgctacgttaagtcgattgatctgcgcgatggcggtattagctcgctggcgtggagtgaacaactctatttcgtctgcttgcaaaacgcccatccggcggcgacgcagataacgctcacttcgcctttgtataacgacagcgacggatttgccaaagcgaaagtcggcgagaccatcccggtcatcatcaccacgcgggacgcccagggcaacctggccgccgacacgccggttatctttacgcgcggcgacagcgtcgggcgcgcgaatcaggaagtgaatagcgcgtcggcggcggagatacagataaaccacagcgacgggcgtagcagcggcgttaaatattacaccgccaccggcgctgacggcacgctgacgctgaatatcagccaggacagcggcgcgggctttaaaacgccgctgacggcggtgatagagcacaacggcgtaacgagcgcgctgctaccggtcatttttaccgtcgtcaccagcccggacacgccgaaagccaactactggggccatatggcggaaacgctgaccgacagcagcggcgtggtgtacaagcgcccgttgctggccagcgagttcagcgtcacgcccggcaaatcgctgaccatcgccaacggttactacgacaaaggcgaaacctggggcatgataaccgtcgataaagcctagaacggcgccggcggcggctgcgggcgcaattatctgcccaccgtcagcaacctccagacgctgtacagtacctggcctgataacgccatgcgcagttgtaacggctggccgatgaccagttctggcaacaataacgtcagccgctactggtgggcgggggattacgtgatgtcgtcagacggcgcgcagtcgctctacgcggcggtcaacctgtttaacgacggcaatgatgtcaaaacgacgaccagcaccacgacgtactatatgcagacctgccttacctcgccacgcagcgccgccgccagcctgacgctgacgctggcaggccaggatgcagccaccgggatcgcaaaagcgaaaaagggcgagcagatggccgccaccgtcacggtgaaagacgccgcaggtcagccgatgaaaaacgtgatggtgaaaatcagccggggatcttcgtacaaccgcgtcaacagcgccacatcgtcctcaagcgctgcagacgatattacgctgcgtaatgtgatgccgtccggcccggcgacatacctgctggatacctccgcgaaatatctgtatgcgcaaaccgatgcccagggacaggtgacatttacccttgcgcaggacagtaccgcaggtttaaagaccaccatcagcgccgccacgatggacggcagcaacctgacagacagcaaagacgctatctttaccgttatcaccagcccggatagcgacaaggcctcatactggggccatatgccggaaacctttaccaacagtaagggcgttgagtttgcgcggccgctgctgcgcgccgagctttcttcaacgacggataccacgtccttcctgtcaaataatgagcactggtacacctggaaccgctatccaaacctgtatcaggactccgccagcccgtgcgatcggctgggattgccgacgctggatgatttaaaaacgttgtataacgactatccgaatggtggactaacggccgcctttgggttgcctgtagacgcggggaaatactggggagcaggggattcgaaagtcaacgatacgcactcgacgaataatttccagtatatcaggctaaataacggcgttacgcaggtcacaaatacgaatacctcaacggcgcagctctgtctggcgaagcgcagggtgttggcgatagcgttgacctccagcgccatgaatgccgaaaaatccgccgcgctggcgaaaaaaggggataaaatcccgctgacggtgaccgtcacggacggcgccggcacgccgtagcccaatgtgcccattcggctggggcgaggaaactattcgcaaaaccgggctggcggtagtgacagcaccaacaacagcgacatgctgttaacgccgattgcgccgccagcggatgctaaagtatttgcctaccattattccggggagcagctctggtactggtacggcactacggatgagagcggcagggtgcagtttgagctgacgcaggataatacccccggcctgaaaacagcgctgcaggcgatgctgtccgacaatccgccgaccgtcagcaatatggatgtcatttttaccgtcattaccagcccggacagcgataaagccaaaatgtggggccatatgccggaaacggcggccaacagcgcgggggtgaaattccaccgcccgctgctggctgcggagatgacgtcgaatagcggcacctactattacaataacgaaacatggcctctggtgactatcgcgaacacccagaaagcgggcgcgaccacctgtgatgctgcatatcagccgttgtttaatgacctgcaaacgctgtatagcgaccatccagacagcgctctcaatacggcattcggctggccggtaggggcgggtaaaagctggctggcggtggaccaggagcctggaaccgggtattaccagtatctgcggctggataccggcgccaaaggccacaccagttccacgagcgtgtctggcgcgcaggtgtgtctggtcgagccgcatacgtctactcctgccaatattacgctgacctcgacggcgatggacagcgcgaaaaacgcggcggtagtggagaagggaagcgcgatgccgttaacggtgacggtaaaagatagcagcggtaacccggtcgccaacgtcggttttacgttgtcacgtggcgattcgaaaaatcgggcaggtacggtggtaacggatggcgacgtggcagcggatgccggagcagatgatctcatgcttaaagagctgactcccgcaagcgccagccgaagtatgaccaccaccgggattgtctttaccggcactaccggcagcgacggtacggcaacgtttacgcttaatcaggataaaagtctggggttaaaaacgccactcacggtgaaactgacggacaatacggctcttcacgcctcactggatgtgatttttatggtacttaccagcccggatacggataaagcgttgttctggggaaatatgtcggatacgacatccgtcaacggaaaaacgctgcatcgtccgtggctgcaggctgagctaccgtcaggcgtgacgccagtatttaccaacggagttcatgcaaataacgagtactgggcgatgacgcatacggtggacaacactaaatgggatattgctaaacagtgcggtagcctgagcaaagcaccggataataacgacctgttgacgctgtatcattcaattagctcgttaggctggccgacgctgggctatccctatttatctaaatcaacctcgggcggcggcatgtattgcggcgtggatgagaatactaagcagcaaaactgcgccattcagccggcaagtacagcaggttatgcgacgtgcgtggagtaacgtattaagcgtctggcacgaaaaataatttgtttttcacgttcaattgagcttcatgaaaaagtgatcggagcattcattgaaaagtatatgttctgctaattggagtcatcaccgtttgccgctggtgtgtagatgcgccgtttcccttctgtaacccggtatctggcgctacctatatacaaaataacaccaggtgtcgcatgataatcacaccttttatctcacgtatctatttatctcaatatatgaaattattaaatgttattcataatataaatatttattaaatagataaatatattcatattaattataaattaaccagaagctgacctggtattgaaataaggcttgaaattagttaataatttgtctttgataatacattgttacagatgacagcaaccattcatagaatcatatttttgttatttattatttaactcatttatatacaccatttaaaagctatttgcagccaatcaaatcaagtttgcttcgtgaatgttattaaaaggaaatttaaaaattgaacaggacctacagtatcgtctggagcgccgtgcgaaatatgtatgtcgtagcttcagaactggcgcgaagccacagcaaagttaaaatacaggcgcacgctaatgaagtcgccccttctattaaaaagcctgattcaggatgggcaagacaccatgcgctggccctggcaattgttgccgcgcttggctttgccagcccgctggccatcgccgataatccggtgtcatacaccgatggggtcaagcacgacctgagcgacgattcgccgatttcctactcaggcactggtgaaggttctgcactgcacctcgaaggccttgcaacgcccgaagggggctggcaggcaacgtcgggtacaggtacaaatgtcgtgattaacaccaacggcggcggcgatcctgttcagggaactcatgctatcgccacggcagttaccctcaacaagggcgcaacacttgacctgaccggggcgcagatctctacggaaggaacctacacggcaggtatcgacctccaggcgcaaagcagcatgacgctgaatggcgggagcatccagatcggaagtaattacggcatcctgaccctctctggcgagtcatgggctgccctgattggcaccgacgttacggcaacgacgcaaagccgtagcagcatagtgtcacaatcaggtagcacgcttaacattaaggacgggagcgtaattacgctgacaaacggccaggtgcgcgtagtaggcgagacgacatacaactcctggctgaatgtgtccgatagcacgatgagctccacgggtacggatagtacgcttcttgtgtccaacaagggcgttcttgatattacgaactctaccgtcacgcacgataatgccacaggcgccgctattgaggtgaaaaacgcctcaacggtgagcatctctgatgataaagattcgatggccatcaactccaaaggcatcggtattaaaatcctcgcctccagcgtggatattaacggcgccaccatcaacgccgacggcgacggcatctttataacaagcaaaggtaaaagcggtgggtatgatgatatcaacgcgctgacggttaacaaagcacaggttaattcagagacgattgcgctgcatgtggactctggcacgacgattaacgatcctatcgtgctaaccgatagcgcatttgacgcgccggcagtgatcaagctgggcagcaaggcggtcattcaggccgacaatacgacattgaacggtgacgttgttcagagtgacatgtcatcgtcatcgctgtctttaagccagggttccacgttaaccggtagtgtagatgcgatgtttactacactgtcgctcgacgatactagccagtggaatatgaccgactcgtcaatcatcggcaacctgaccaacaacggcgacattacgctgaacaacgagagcggttcgacaggcacgctgctgacggtgggcaataccctgaccttgcaggacggcagccagataaacgcgacgctggataccgccaacagctcgccaattatcaaagccgccaacgtgacgctggatgggacactgaaccttagctcagcggccacctttgtcgcgcccgaaaccgacgagcagttaggatcgttcacgctaattgattcgcaaaccgcgattactaccgattttgacagcgtaacgctggatgccgacacctctgctatgccggattacctgacgatcaacgcgggcgttgatgcgaatgataataccaactacgtgttgtctacgggcctgagctggtacgcggacgcaaaatctgcgcgcgttgcgcacggcacctttaccgttgacgcaggcgatacctttaccgtcaccagcgaactggatgaaaccgcggccacctccaactgggacggtaaaacgctgttcaaagaaggcgacggtacgctcgtcctcagcaacacggcgaacgacttcggcaataccgacattaacggcggtacgctgtctgcgaatgatgccgccgcgctcggcagcggcgacgtggccattgcagaaaacgcaaagcttgagttgagccaaggcacgctggataacaacgtgaccggcgagggccaaattgtcaaaagcggtagcgatgagctgatcgtgaccggcgataacaactacagcggcggtaccactatttccgacggcacgctgattgctgaccatgcagattcgctgggtaccggggctgttgccaacagcggcgtgcttcaggtcggcgaaggcgagctggaaaatacgctttccggcaacggttcgctgatgaaaaccggtacgggcgagctgacgttaagcggcgacaacacttactccggcggcaccactatttccggcggtacgctgattgccgccaacgttaacgcgctgggcggcggtgatgtcgataacgcgagtacgctgaagctggacgcggagggcgaattcaaccttgcgaatgtcacgacccagtctggagcaacgactgagctgtccaaaggtacgacgctcaacgtcgactcgctgactcagcaagccgatagtacgctgaatattgacctcagtaagactaatggtgaaagcgccattaccgctgacagcgtctcgttggctggtgcgctcaacattaccgggatcggcaacgtcacagacagctggacgcctgaggcatacacctacacgctgattgacagcgacagcgccattacgaccgatttcaatgatttgaccgtcgcgggaatgaatagcgaagatgttgacttcctgaccatcgacggaaaagtcgacgaagcagatagcacaaactatgatctgacggcctccctctcctggtatgcggacagagacaacgcttctaccgacgcccacggcacctttacgctaagtgaccctgacggcagctttaacgttgcggctaaactgacagatgttgatgacgcgctggatccgggcagcacatgggacggtaagtcgctgaccaaagaaggcgcaggcacgctgatcctctccggcgacaacgactacagcggcggcactacaatcaatgaaggtacgctggtcgccgccagcacgacggcgctgggcaccggtctggtggacaataacgccacgctggtactggacgcagacggtgaagtcagcgcggtgggcggcatcaccactcatggcggcgcgacgacccaactggcgctcggcacctcgttggatctcggcgacagcgcgttaattcaggaagatggcagtacgctgaacgttgagctgaatagtgactcagcgcaaccgctgattaccggtggcagcgccacgcttggcggtgatttggtcgtcagcgacgccagcctacaagcgcgcgcctccgacgcggagttccagtcctttaaactgatggatatggacagcgatatcagcggcgactttaccagcctgacgatgaacctcaccgacaagccggactatctgaccgtaaccggaacaatcaatcctcaagaccagtctgaatacctgcttaccgaagggctgagctggaatgcgaccgccacgtcagcgacgccagcacacggcaccttcactctgggcgcaggcgatagctttgaagtcaccagcgtactgggcgataaaaccggcaacggcggctcgctttacctgaataccgtcctgggcgacgatgattcggcgaccgataagttggtcattaccggcgatgcctccggcaccaccgatctgtacatcaacggcatcggcgatggggcgcagaccactaacggtatcgaagtggtggatgttggcggcgtatcgaccagcgatgcgtttgtgttaaaaaatgaggtaaacgccagtctgtatacctaccgtctgtactggaatgaaagtgacaacgactggtatctggcgtcaaaagcacagtctgatgatgacgacagcggtggcgatgtcacgccttcggacgacggcggcgacggtggcgatgtcacgcctccggacgacggcggcgatgtcgcaccacagtaccgtgcggatatcggcgcgtacatgggcaaccagtggatggcgcgcaacctgcaaatgcagacagaccctctatgaccgcgagggcagccagtatcgtaacgctgatggcagcgtctgggcacgcttcaaagcgggtaaagcggaatcagaggctgtcagcggtaatatcgatatggacagcaactactctcagttccagctaggcggcgacattctggcttggggtaacggccaacagagcattaccgttggcgtcatagcgagctacatcaacgccgataccgacagcaccggtaaccgtggcgcagacggtagccagttcaccagcagcgccaacgtagacggctacaaccttggcgtctatgccacctggtttgccgatgcccaaacgcatagcggcgcgtatgtcgacagctggtaccaatatggtttctacaacaacagcgtagagagcggtgatgcgggatctgaatcttatgattcaaccgctaatgctgtctcgctggaaaccggttatcgctacgatattgcgcttagcaacggtaatactgtcagtctgacgccgcaggcgcaggttgtctggcagaactactcagcggatagcgtgaaggataactacggcacccggatcgacggtcaggatggcgacagttggacaacgcgcctgggtctgcgtgttgacggcaagctgtacaaaggcagccgtacggttatccagccgtttgctgaagccaactggctgcacaccagcgatgatgtgtcggtatcgtttgatgatgccacggtgaaacaggatcttccggctaaccgtgcggagctgaaagtgggtctgcaggcagatatcgataagcagtggagcgttcgcgctcaggttgccgggcagactggcagcaatgactttggcgatctgaacggtagcctcaatctgcgctataactggtaagttagacaaaaccgggcgggtattccctgcccggttttgaggcgaatgacaaaccggttgagcgtcggattgtggctacaccttatccgacgtggcgcgtgggttggctgaggtgaagtcgaaacccaacatcgcgctgcaaaaggtgggggagtgttggattacgttcccggcgtgacggatttgacttcactttcaagccagccgtcctccagccgcgtggtcatgatatcgcctgctttgacctgtttgatctttttcaacaccttgccgtccgttgtcgtcgaaaccgtatagccgcgcgccagcgtggctaacgggctgaccgcttccagatgcgtgaccgcgttgccaaaacgctcgcgctgttcgcttaaccgtgagcggatattctccgtcagacgatattccagctgttggatgcgcgactgcacgcggtgaatgcgcggctgcggattttgctggctcaggcgttgacttacgcgttgctgacgctgagtggcctgcttaatcctggcctcaagcgcaaatcccatccgttggcgtagacgttccagcgcggtttgctgacgggccagacgtagttgcggatgttgttgttgcagacggtgaaaaatctgcgtgaaacgacggctgcggttggcgaggtagtagtccatcgccatgcccagacgctgctgggcggactggatctgacgcaacaactcctgctggttacggctgacaatttctgccgctgctgatggcgtcggcgcgcgcaggtcggcgacaaaatcggcgatagtgacgtcggtttcgtgaccgacggcgctgaccaccggaatacggctggcaaaaatagcccgcgccacgcgttcgtcgttaaaactccacaaatcttccagcgaaccgccgccgcgtccgacgatcagcacgtcgcactcgccgcgcgtgtttgccagttcgatagcacgaacgatctgccccggcgcatcgtcgccctgtaccgcggttggatagataataacgggcagggatgggtcacgacgcttcaacacgtggaggatatcgtgcagcgccgcgccggttttcgaggtgatcaccccaacgcagtgggccggggagggcaacggctgtttatgctgctgatcgaacaagccttcggcatggagtttggcttttagctgctcatacttctgctgcaacaagccttcgccagccggctgcatactttcggcgatgatttgataatcgccgcgcggctcgtacagcgtaatgttggcgcgtaccagcacctgctgcccgtgctgcgggcggaacgtcacccggcggttgctgttgcggaacatcgcacagcgcacctgagcggtatcgtctttgagcgtaaagtaccagtggcccgacgcaggctgcgtgaaattagaaatctcgccgctgatccatacctgtcccatctcctgttctaacagcagacgaaccgtctggttaaggcggcttacggtaaaaattgaggaagtttgagaggataacatgtgagcgggatcaaattctaaatcagcaggttattcaatcgatagtaacctgctcacgggggatcgcaagcactatttgcaaaaaaatgtagatgcaaccgattacgttctgtataatgccgcggcaatatttattaacctcccaggtgagatattgcccatgctacgtatcgctaaagaagccctgacgtttgacgacgtcctccttgttcccgctcactccaccgttttgccgaatactgctgatctcagcacgcagttgacgaaaactattcgtctgaatattcctatgctttctgcggcgatggacaccgtgacggaagcgcgcctggcaattgccctggcccaggaaggcggcatcggttttatccacaaaaacatgtctattgagcgccaggcggaagaagttcgccgcgtgaagaaacacgagtccggcgtagtgaccgacccgcagaccgtcctgccaaccaccacgttgcatgaagtgaaagccctgaccgagcgtaacggttttgcgggctatccggtggtgactgaagataacgagctggtgggtatcatcaccggtcgtgacgtgcgttttgtgactgacctgaaccagccggtgagtgtttacatgacgccgaaagagcgtctggtgaccgttcgtgaaggcgaagcccgtgaagtcgtgctggcaaaaatgcacgaaaaacgcgtagaaaaagcgctggtcgttgatgataacttccatctgcttggcatgattaccgtaaaagatttccagaaagcggaacgtaaaccaaactcctgtaaagatgagcagggccgtttacgtgtcggcgcggcggtcggcgcaggcgcgggcaacgaagagcgcgttgacgcgctggtggcggcaggcgttgacgtcctgctgatcgactcttctcacggtcactctgaaggcgtgttgcaacgtatccgtgaaacccgtgctaaatatcctgacctgcaaatcatcggcggcaacgtcgcgacgggcgcaggcgctcgcgcactggcggaagccggttgcagcgcggtgaaagtcggtatcggcccgggttccatctgtaccactcgtatcgtgactggcgtgggcgttccgcagattaccgctgtttctgacgcagttgaagcgctggaaggcaccgggattccggttatcgctgacggcggtatccgtttctccggcgacatcgccaaagccatcgccgcaggcgcgagcgctgtcatggtcggttctatgctggcgggtaccgaagaatccccgggcgaaatcgaactctaccagggccgttcttacaaatcttaccgcggcatgggctcgctgggcgcgatgtccaaaggttcctctgaccgttacttccagagcgacaacgccgccgacaaactggtgccggaaggtatcgaaggccgcgtagcctataaaggtcgcctgaaagagatcattcaccagcagatgggcggcctgcgctcctgtatggggctgaccggttgtgctaccatcgacgaactgcgtactaaagcggagtttgtgcgtatcagcggtgcgggtatccaggaaagccacgttcacgacgtgaccatcaccaaagagtccccgaactaccgtctgggctcctgattttcttcgcccgaccttcgcgtcgggcgatttatttaatctgtttcacttgcctcggaataagcgtcaatgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaacccaagcggcattattctttccggcggcccggaaagcaccaccgaagaaaacagcccgcgcgcgccgcagtatgtctttgaagcaggcgtgccggtatttggcgtctgctacgggatgcagaccatggcgatgcagcttggcggtcatgtagaaggttctaatgagcgtgaatttggttacgcgcaggtcgaagtgctgaccgacagcgcgctggttcgcggtattgaagattccctgaccgccgacggcaaaccgctgctggacgtgtggatgagccacggcgataaagtgacggcgattccgtccgacttcgtgaccgtagccagcaccgaaagctgcccgttcgccatcatggctaacgaagaaaaacgcttctacggcgtacagttccacccggaagtgactcacacccgccagggtatgcgcatgctggagcgttttgtgcgtgatatctgccagtgtgaagccctgtggacgccggcgaagatcatcgacgacgccgtggcgcgcattcgcgagcaggtaggcgacgataaagtgatcctcggtctctccggcggcgtggattcttccgtaaccgcaatgctgctgcaccgcgcgatcggtaaaaatctgacctgtgtattcgtcgacaacggcctgctgcgtctcaacgaagccgagcaggtgatggacatgtttggcgaccattttggtctgaacatcgttcacgtaccggcagaagatcgcttcctgtccgcgttggctggcgaaaacgatccggaagcgaagcgtaagatcattggccgtgtttttgtggaagtgttcgacgaagaagcgttgaaactggaagacgtgaaatggctggcgcagggcaccatctaccctgacgtcatcgaatctgcggcgtctgcaaccggtaaagcgcacgtcatcaaatctcaccacaatgttggcggcctgccgaaagagatgaagatggggctggttgaaccgctgaaagagctgttcaaagacgaagtgcgtaagattggtctggagctgggcctgccgtacgacatgctgtaccgtcatccgttcccggggccgggcctcggcgtacgtgtactgggtgaagtgaagaaagagtactgcgacctgctgcgccgtgctgatgccatcttcattgaagagctgcgtaaggcggatctgtacgacaaagtcagccaggcgttcaccgtcttcctgccagtacgctccgttggcgtaatgggcgatggtcgtaagtacgattgggtggtctctctgcgtgctgtcgaaaccatcgactttatgaccgcgcactgggcgcacctgccgtatgacttcctgggtcgtgtttccaaccgcatcatcaatgaagtcaacgggatttcccgtgtggtgtatgacatcagcggtaaaccaccggctaccattgagtgggaataagtcgataacccttcctgtgttttcatgaacaggtaaaagtgaatttaaccctctgtttttgcagagggtttttatttatgtgcatagatgcattttctgtgtagtgcacagcttctggcggcaaagcactgcatcgacacaatagtgggtttcactggcagcacacaatcaaatctgacagtcggcttcgagcgaggtgcggacattggtagcttcaacaacatgactggcattgaggtgtattaatcaacgggaagcaggtcagtttactccgccagcccgacttttacgaaagggctaccatgactacgcgattttttgattagcttgccaacgtataatcctctgatttctggtgatgcgattcgtccaacaaattctgaacggttggtttcgggggggggatgaccaattcccgggtaaagtattgctgagagcctgccttcaaccagcactgtatctcgtaaacttccatcaccaaaccgccgtaggtggcgtatgcaaattgtaggttttcatcttttggtacttttgcccagacgccacgcgtagcttcatataatgcaagtgcactcatgccagacttgtaggtgctgtttagcaaaaaagcgagcccggcatgttcaggtgcgatttccgtctcttgcttaagaagaagatgattgagctcatccagcgtgattcgccccataagggagctgcttcctcgtactttgttggtcagttctccaacacccaagagatcaatacatgttgcttcaacaagcttcgcggttgcctcatccatgccatggcgtagtatgtcgatacccagatttcctgtttttaacagatgattaattcgttctgatttcggagagtcatcattatactttatatgatcaaggcagcgttctgacttgcctttgcctatataaaacggcttcttagctgcatcttcagtgtcataaaatgcataaacatagaacttagccatccctaacgcttttgagtattttgaaaaatctttcaaaccttgcttccttaaggcaaaagtacttaattttactatcggcactatagttcagaacttaagcgcaaaacaattagcgtatagattgacctgcgtccattgatgaatatgggccaaagttaacaacgtccgctattggcacagacctgcctgtcagattaggtttaggtctgtgccatagctatgtcaggtcaaatctgagctaatacacataaatgattagcgaaatcagttaaaccagccgcttgccttttcctcacgggctttaccttcgctttgcagcagatcgcgaccgccttcagatagatttctgtttgcatcagcatgagattgaataacatctgtctgggcagctttacttttcagctcttgatcgatgaattcattttctctttttacccgggcctcttccctggccagcgccagtttttgtttctgaatttctaaacgacgaagctcatcttcgtagctttgatcgcgcgctttatcttgcgcggcttccgctgccaattttgcttgccgtgctttccgttcagcttctgccgcttttgctcgctgcttagcaaccgctgccgcattggcttgcctttgtctttcctgttgagcctcttgatctcgtttggcttgcagagcatcacgctgtctgttttcttcattttttccttgctgttcagcctgggctaccgccgcaagctgatcctgcaaagaagaagataaaaccgagccgcttagagtgaataaaacagcgcctaaaataactttcttcataaaatctcccgatagttagcttttctcaggacatttcgtattgggttgaattcgcgtttcgttatctttggtcgatatcaccatagccagaccggtggtaaattggcacgtttttcccacctgggtggaggtataaaccttcgttccttctttgtaagtcaaagatacggcttcaactaacgttttatctttaaccaatgaccccgccgctgcgccaacggctccgccgccaaccgcgccggcagtagtacccaaaccgctacctgagcccacgttatgaccagtaacgccgcccgctacagccccaagaattgcgccgaaggtctgagcggtttttttattggcggtgttatctacggcaactttcgctggcaaaacagagataatattgacggtctttgtttcttgcttcgcgtttaactgcccggtttggtaaacatctgcggcgtagtcatccgcattggactggcatccggcaagagaaaaagaggcaaacaaaaccagaggcaaagcattttttttttaaattcatcacaattccttgtttaggtaataacgcaaaaaggaatgtatttaagactaatcttaaaaaaagtaaactatcgtttcttgtagttgattgttttttttagactaaaaaacaaagcattagatgatacgatgctttgtttttatcggttcatgctaagccagggaaggggataacagagcgctggataacacggcaaacctgtgacgataataccgccatcactattttaacggataacagcttaacgttgtcccggcgtggtgaccgaaagcgatgactgttgcgcttcttttttatcctgatggtgctgccaggcgccgatagaagagtagacgaaacgtccaaagaagaagagaaaactgataagcagtacgatacgggtcatgcgagtgttaaatcgatgtcgttttcgcatactgttggcctgacttacaaagggttccttaacgttggcccagcggtatgggcgggatcaggctgggttcttcaaaggtattatcaaggcgaagaacgtaacaagcctgcgttcactctacattaaggcatactgcgaaccgatggtcaattcctcttaatgtaaaattgcgtcagttgatttatcttatattgttatggaagataattttagtatttacattaataataaattaatgataacaaagaataaaaagacgaataaaggctgcaggagaaaggtaataattgacttaaatcaaatgttacttttgtttaataattacaatcgatgactatcgtgtgatgtatatcgcatcatcaatttaaagtcaggtgggatgcctgtctgttaacgcccctttgggattggggggttctgctgagcatctatgaagctgaataaaacttatataaatatcagagataaatggtggggactaccgctcattctcccttcgattttactacctgttttaagtagcgcaaatacttatgcgcttaccagcactggaaatgtggttcttttttacctgccgttagcttttatgcttagtctgatgctctttttcggctgggcagcactgccgggcattgtgcttgctatcttctggcgcagatacccgcagacagggctgtatgaaaccctttctgtgacgatgcactttatcattactatcgtgctaagctggggcggctatcgtgtcttttccccccggcgaaacaatgtttcccacggcgacgcccacctgttgtttcaacgaatgttctggcaggtattttgttcagcgacattatttctggtcatttaccagtttgccgcttttgttggcatgtacgaaagtaaagccagcctgatgggggtaatgccctttaatatcaacacgctgattaattaccaggcgttactggtcggtaaccttgtcggcgtgccattgtgctattttattattcgtactctccgcaatccgctgcacctgcgggggtattatcagcaattaaagctacagattgatagcaaggccactaaaaaagagatcgttatttggctggctgtattgactacactaatgtttatactgtgtatgccattgacggataatagctcaatatttagtaccaactatacgctttcgttattattgccggtcatgctgtggggcgcgatgcgctatggttataagtttatttcaattatctgggccgtcgtgctaattacgtcgattcattattatcagcgttatatgccctggtattcaggttatgatacgcaattagcgattacctcttcgagctatctggttttttcttttattgttaattatatgtctgtactggccacgcgtcagcgcgtagtgagtggtcgcgcacggcggctggcctatcttgacccggttgtacatcttcccaatttacgtgcgttaaaccgcgcgcttaaaaatgcaccctggtctacgatctgttttttacacgtgccgggtctggagctattgggtaaaaattatggcgtcatgctacgcatccagtataagcaaaagctctctcactggattacgccgatgttggcctcaaatgagtgcgtctaccagatgtcagggcacgacctggtgctgcgtcttaatacagaggcgcatcagcagcgtattgaagcgctggataaacatattaagcagtttcggtttatttgggatggactgccgctacagccgcctgttggcgtgagctactgctgcgtgcgttctccggttagccacctttatctgctgttgggcgaattaagcaccagttccgatctttcgttgacgactaacgcgccggaggatttacagcggcgcggcgcaatgcacctgcagcgcgatttgaagggcagaattgcgatgatgaatcgcctgcaacaggcgttggagcacgatcattttttcctgatggcgcagcctattttcggtgttcgtggggacgtttaccatgaaattttactgcgactcagggatgacaacggcgacgttatcaacccggacaattttttacccgtggcgcatgagtttggtttgtcttccgctatcgatctctgggtgattgaaaacacgctacggtttatggcggccagccgggaatatatgcccgcgcatcgttttgccattaatctgtcgccaacatcggtatgccgcgcccgtttccctgcagaagttaagcagctgcttacgcaatatcaggttgaaccctggcaactggtttttgaggtaacggaaagcaactctctcaccaatgctgagcaggcgcagttgacactgggacagctacagcagtttggctgtcagatagcgattgatgatttcggtactggctacgccagctatgcgcggctgaaaaacgttgacgccgatattcttaaaattgacggcagttttattcgcaatatagtgtcaaacagtctcgattatcagattgtggcttctatttgtcatttagcgcgaatgaaaaatatgcaggtcgtcgcggagtatatcgagagcgaagaaatacgaagcgtagtgctgtcgttggggatcgactatcttcagggatatttaattggcgagccgcagctattatctgagattcagtaaaggcagacgccgcagcgcggcgtctgatccacaatttacgcggcgatctccggcgagctttcttcctcaatattgagacgccagccagttaccgcttcccagtactgctgttctttttccagatcaagcagtaccagcgcattctggctgaaccagtcatgcggaaaacataacgtccagtggctgtcatcggtcgttagccgcagcgtcggcggtgtggtggtcgcctgccgctggttgttcagtaatacgcccagccgaagtagctgaattaacggcagatactgttttttcttaaacagcgtaaagcggggcatatcatccagttttatggctttacgatgataacgcaccagcgtcgccatcatcatttgctgctcctgattaaagccgggcaaatcgctgtgttgcagaatataagccgaatggcgatgtaaaccgctgtgattaatattcagtccaacctcatgcagcattgccgcccagcggagcaacgcttcaagctgcggatgcgccagttttggctgctgggcctgccactgctcgtacatctgcatggtggtttccagcacacgtctggcctgttctctgtcaatgttgtattgattggccagactttttgcggtacggctgcgaacatcctgatggcggaagcggccttccatttcatacagcacgccttcgcgcaacgcgccgtcggaaaggcgaagctcgcggatagccagagcatcaaaaacgccgcacagaatcgccaggcccggcacaaagaccgcttttcgttcttcagacagacccggcaggctgagcgcattaaaggagcggtgcttcaacacttctgacttcagtttatcgaggcgctccggcgtaatgaagccatctttctcacccagcgccaggagaacttcatgagcggccttaatcgtaccggaagcgcccatcgccacgttccaaccctgaatacgatactgccaggttaaggtttccagtttttgcgctgccgccattcgggcgcgctggaagttttctttattgataacgccgccgggaaagtagagctgcgcgaagctcacgcagcccatacgacggctttcaaccagcctgggttcgaagttttcgccaataaccagctctgttgatccgccgccgatatcgatcaccagcttgcggcctttttccggctgcgtatgttctacgcccataaaaatcaggcgcgcttcttcgttaccggaaataatctctatcgggtagggaataaccttttccgcgcgtttgagaaaatcagcggcattttgcgcctgacgtaacgtatgggtgcctacgatacaaacgctggaaggggagaaaccttgtaagcgttcagcaaacagcgacagacagctaagcccccgttccatggcttcttcgctgagtttgttatctgcgcccagcccgtccgccagatggacgcgctgttttaagcgcccgataatctgcattgcgccgtcaaccacgcgggcaatgaccatatgaaagctgtttgagccgagatcgaccgcagcgaactcctgcgggcgaggggatttatcgtaaattggcatagcgttagtctggttgctcgagtgatttgatgtagtcataaattgccagctgcgcctgaactttgcggcgattgccgcgcggtacgtagcggttgctgagttctttatcgataaaacgcgcttttaccgtgtcgctaaacagaatgtcaatgatatccaggacgcgttgtttaagccgcgggtcgaggataggcgtagcgacttcgatacggtagtcaatattacgcgtcatccagtcagctgaagagagccaaacttgcttatcaccgccgttttcgaaaatataaacccgatcgtgttccagatagcgatccacgatgctaatcgcgcgaatattatcgctaatgccttccagttgcggaataagagaacacataccgcgcaccagcagattgacctggacgcccgaacccgacgcggcgtatagcctgtcgaccaaccctttatcgaccaggttgttaagctttaaggtaatccctgacggtaagccttgctgggcattggcaatttcacgatcgatcatctcatacagcagacgccgtgagttttgtggagaaaccatcaaataatcgaaagtgaccgggcgataggggttttcaataaaattaaagacccggcgcacttcattggtaatgcgcgcatcggcggtcagcagcgaataatcggtatacagccgcgccgttttttcgttgaagttaccggtgccgatatgcgcataacgcaccacgtcatcgccctcttttcgtgagatgagaaagagtttggcgtgaattttcagcccgggcgcagagaaaataacatggacgcccgcttcggttaaccgcttggcccagtgaatattcgcctcttcatcgaagcgcgcctgcaactccaccaccacggtgacttttttgccgttatgggcggcatggatcatcgagtcaataatgcgcgagtctttcgctacgcgataaatattgattttgatcgccagcacgcttgggtcaaacgacgcctggcgcagcagttccagtacatgctcgaaggtatggtacggataatagagcagcacatcacgttcacgaatcgcgtcgaaaccgttacgaaacttctctttatcaaaccaaagatggcgtaaccgcggtaacggtttattgaccaggttggctttaccgacattcggaaaattaataaagtctttaaaattgtggtagcgcccgccgggtacgattgagtcataccgggagatcgtcagtttttcccgcagcacgtcgaccagcgcggcgggcatatcgcgttgatagacaaagcgcacaggttcagcggtcaggcgctgcttcaggctggaggacatcagctccatcagactggattccatctcatgcaccaggtcatattcggcatcgcgggtcattttcatcgaataggcattgagcgcgtcatagtcgaagaaccctttaaaaatgtcatccaggcagtagcgcagaatattatccagtaggatcatcggcttgcgtctgcgcggtgtctccggcggcagattaacgaagcgtgggactttgtcggacggtatctccagcagcgcatagttgatggtgtcgccgcggataatctccaccgccagataggtgtaatcatcttttaaaaactgaacaagatccgtctcccggttaatgagaatcggggtaatatgctggcgcaaatagtgcttaaaatagtggcgcaaccagctttgttggttcaccgagagctgacgctcgttgatcagaaagatttgattacgcgccatttccagcagtaattcgttgtacaggccgtcgaacccctggtctgctttcaacacgcgggactgaattttgcctaacaaatggcgtgaatgagaatttgaaccctgttcttcgctgataataatgcgtcgtttcagttcagcgaaacgcactttgtagaactcgtcgaggttattagaatagattcccaggaaccgcatccgctcaatcaacgggttggatttatccgctgcttcctgtaacacgcgttcgttaaatgctaaccagctcagctctttctcgatatatagcttttcctgacccattactacctatactccgttttattcacgggacactgcctgataattatggcgagcattacgcgttaatgtccaacagcgtcagaaaaatatgacaataaactgatagcataaaggaagggaaaagagtaggccggataggcatttacgccgccatccggcaagcagacgcagccctggccgatgacatattattcgtcagacgcataaccttgcggcggcagacgacgcccgtccagccaggcggcgttatcgcgcatctttagacgcccctgcgcaaaccagccaatcaccagcggataaatcgcatgttcctgagtttgtacgcgtgcggtgatatcatcttcgctgtcgttggcaaaaaccggcaccttcgcctggagaatgaccgggccgccgtcgagttcgtctgtcacgaaatgcaccgaggtaccgtgctcctcatcgccgttttccagcgcctggcgatgggtatgcaaccccggatattttggcagcagggaagggtgaatgttcagcagacgcccgtagtaatgcgcgacaaacatcggactcagaatacgcataaaaccggccagcacgaccacatcgggcgcatacgcgtctatcttgcgaatcaactcgcgatcgaaggcgtcgcggctgtcaaaccgatcggcagtcagcgcttgcgccggaatgccggcttctctggcgcgttcaaggccgaacgcgtcggccttattgctgaatactgccctgagggtgcctttaattttcttcgcttcgcaggcatcgataatcgcctgtaaattgcttccattgccggaaatcagcaccacaatattcattattcaataaccacacgctgttcggaatcagaggctttgatgataccgattttccatgcgttttcacctttctcgtttagcagagcaagcgctttgtccgcttccggagcagagagcgcaatcaccatgccgacgccgcagttaaaggcacggtacatttcatgtcggctgacattaccggcggttcgcagccaggtaaagatggcgggccactgccaggacgactcattaattaccgcctgggtattctccggcagaacgcgcggaatattttcccaaaagccgccgccggtgaggtgggcgatagcgtgtacatcgatgttttcaatcagttccagaaccgattttacgtagatacgggtcggttcaagcagatgatcggccagcggtttcccttccagcagagtggtctgtggatcgcagccgctaacgtcaataattttccgcaccagcgaatatccattcgagtgcgggccgctggagccgagcgcaatcagcacgtcgccttcggcaacccgggagccatcgatgatttctgatttttcgactacgccgacgcagaaacccgccacatcgtaatcttcgccgtgatacatgcccggcatttccgccgtctcgccgccgaccagcgcgcagccggattgcaggcagccttcggcaataccgttgatcacgctggcggcggtatcgacatccagtttaccggtggcatagtaatcgaggaaaaacagcggttccgcgccctgaacgaccagatcgtttacgcacatcgccaccagatcaataccgatagcgtcgtgacgctttaagtccatcgccaggcgaagtttggtgcctacgccgtcagtgccggaaaccagtaccggttcacgatatttttgcggcaacgcgcacagcgcaccgaaaccgcccagaccgcccataacctccgagcggcgagttttcttcactacgcctttgattcgatcaaccagagcgttacccgcatcaatatcgacgccggcatctttatagctaagagaggtcttatcggtcactgcctggttccccacgttttttcttgcggtaaaagttaaattcggcgcaattctaacagggaaagcaaacgtttgcgagcgtggtctgcgccctggttatccgggcgattttttggcatggtttcggtcgctgcttgaaaatttccctgttggtaaaaaagaaaaggatatccagcacttggtttacgacaggtggtcgggacaggtcattcacccttaaaattgctaagattcaatcggttgttagcttttatcgccagtttcaacgtgagtgatttatactcacttttccgctatcagcgcttttggttgatccaggtcaagcatacattgtgttgcgtcagagaggaaaagcggtataatccggcgattttttttgtggttgccagtcatctgaggataggagaagagtatgaagatcgtggaagtcaaacacccactcgtcaaacacaagctgggtctgatgcgtgaaaacgacattagcactaaacgctttcgtgaactcgcctcagaagtaggcagcctgctgacgtatgaagcgacagccgacctggaaacggaaaaagtcaccatcgaaggctggaatggcccggtggaaatcgaccagatcaaaggtaaaaaaattaccgttgtgccgattctgcgcgcggggttgggcatgatggaaggcgttctggaaaatgtaccgagcgcgcgtatcagcgtagtcgggatgtaccgtaacgaagagacgctcgagccagtaccttatttccagaaactggtatcgaacattgatgagcgcatggcgctgatcgtcgacccgatgctggcgaccggcggttctgtcatcgcgaccatcgacctgctgaaaaaagcaggctgtagcagcattaaggtgctggtgctggtcgccgcgccggaaggcattgcggcgctggaaaaagcgcacccggacgttgaactgtacaccgcctctatcgatcaggggcttaacgagcacggatacattattccggggcttggcgatgccggcgataagatttttggtaccaaataagtgaataaataattaaaagccgactttaagagtcggcttttttttgaataaaaccactaataacaaacacacttagaggaaaacactatgacgcgccgtgctatcggggtgagtgaaagaccgccgcttttacagacaatcccgcttagtttacagcaccttttcgccatgtttggcgcgaccgtgctggtgccagttctgtttcatatcaatcccgcgacggtgctgctgtttaacggtatcggaacgttgctgtatctctttatctgcaaaggtaaaattcctgcctacctcggatcgagctttgcctttatttccccggtattactgttgttgccgctgggttatgaagtggcgctgggcggttttattatgtgcggcgtgttgttctgtctggtctctttcatcgttaaaaaagcgggcaccggctggctggatgtgatgttcccgcctgcggcaatgggcgcaatcgttgccgtcatcggtctggagctggctggcgtcgcggcggggatggccggattgctgcctgcgcaagggcagtcgccggacacgaaaacaattattatctccatggtcacgctggcggtgacggtgttcggctccgtactgtttcgcggtttcctggcgatcattccgattttgatcggcgtgctggcgggctatgcgctgtcattcgcgctgggggtggtcgataccacgccgattgcccaggcgcactggtttgcgctgccgaccttctatacgccgcgttttgaatggtttgcgatcctgacgattctgcccgcggcgttggtcgtgatcgccgagcatgtcggtcatctggtggtgacggcgaatatcgtcaaaaaagatttagtgcgcgatcccggtttgcaccgctcgatgttcgctaacggactgtcgacgatcatttccggtttcttcggctccacgccgaataccacctatggggaaaatattggcgtcatggcgatcacccgcgtttacagtacctgggttatcggcggcgcggcgattttcgccattctgctttcctgcgtcggcaaactggcggcggcgattcagattatcccgttacccgtgatgggcggcgtctcgctgctgttgtacggcgtcatcggcgcgtcggggattcgcgtcttgatcgaatcgaaagtcgactacaacaaagcgcaaaacctgatcctcacctcggtgattttgatcatcggcgttagcggcgcgaaagtgcatatcggcgcggcagaattgaaagggatggcgctggcgaccatcgtcgggattggcctgagcctgatttttaaactgattagcctgttgcgtccggaagaagtggtactggaggcaaatgatgcggagtctccgcatcagtaacgggttgccgggcagcgatgctgcccggttctatctcacgggaattatgtggtaaactcagcgcgattttatgtcatcctgggttgaggtatctctgaacacaccggcacagctctctttgccactttatcttcctgacgacgaaactttcgcaagtttctggccgggggataacgcctctctactggccgcgttacaaaacgtgttgcgccaggaacatagtggatatatctacctttgggcgcgtgaaggcgcgggccgcagccatttgctgcacgccgcctgcgctgaactgtcgcagcgtggagatgcggtaggctacgtcccgctcgataaacgcacctggttcgtgccggaagtgctcgacggtatggaacacctctcgctggtgtgtattgataacattgagtgcgtcgctggcgatgaactgtgggagatggccatctttgatctctataaccgcattctggagtccggtaagacgcggttattgatcaccggcgatcgtccgccaagacagttaaatctgggcttacccgatctcgcttcccgtctggactgggggcaaatctataaactccagcctctttccgatgaagacaaacttcaggcgctacagttgcgtgcccgattacgggggtttgaactgccggaagatgtcggacggtttttactcaaacgtcttgatcgcgaaatgcgcacgctgtttatgacgctggatcagctcgatcatgcgtcgatcactgcccagcgaaaactgacgatcccgtttgtcaaagagatcctgaaactgtaatacgccgcgacggcggcgtttaacggttaaccgaggatgtccagcacctgctcaggcggtcggccaatacgcgcctgaccatttgccactacaatggggcgctccatcagtttagggtgttcaaccagcgcctggattaacgcctcttcacttagctggctatccgccaggtgaagcgtcttatagagatcttctttctggcgcatcagttcgcgcgcgctggacatgcccaacatacgcagcagttcccgcacggtggcggcatcggcgggcgtatccagataaagcaccacttccggttccacgccgttagatttcagcaggttcagcgtgtcgcggctcttcgagcagcgcgggttatggtagattttaatcgtgtcggtcatgagttctccttgtgacgccatccggctaataaacggcgattacattttcgtgtatggcttgaagcgttcctgtaactggcgcaactggtcgatacgcgcatcgtaacgcgcctgttgctgactacccagttttgcctgggcgctggcgctgctgagcagtgaaattgcctgatccagtcgtcccgccagcgcataactttcagcgcgtgccgccagctcctgatcgcggttgttcagcgcggcttcggcctgagcaagcagatcccagccgttaccgtcatctttatggctaaaggtgtagcgattcagaatggtttccgccgctttcggctggcctccctggaggtacgcattggcgaggtttaactgcagcacaggattaacgcgcagatcgcgggcatttttcaggcgattaatcgcgtcgttggctcttttctgccccaggtcaatatcggtggcgaggtcaagataccaggcattgttcggctctgcgcttaatagcggctgcaacgttttgcgcgcttcatcgtacttgctcgcttccatcgcctgcaacgcccggccatattgcgccgcatgttgctgacgcacgttgcctttagaccactgatccagcaggtcgctggtgagctggttacgtccggaattgtacattcccagggcgcgcgctttggcgaaataaaagtcggcggaagattgcaccacgaccgggcgcatctggttggcacggttgcgggcatccgcaaggcggctttccggtaaggggtgagtgagcaaaatttcaggcggtcgcgtggagtaacgcgcctggtcgagcagtttttcgaggaaagagggcatcgcctgtgggtcaaatccggcgcgttgcagtacctgaataccaatacggtcggcctcttgctcattttgctgggtgaaacttatcattccctggcgcgttcccgccagagtaccggttagcgccgccataccggcctgtgggctggccatggccagcaaaatggaacccagcgcgcccacccaggtaagcggcgcgctgcgcttttgatcttccatcgcgcgcgccagatggcgctgcgtaacgtgggaaatttcatgcgccatgactgaagctagctggctttcgttatccgcgtagcgaaaaagcgccgagtgcagcaccacattgccgccaaagaacgcgaacgcgttgatttcgtcattattgatcaagaaaaaatggaagggcgttttgacggagtctgcgtgcgagaccagacgcatccccagcgcgttaatgtattgcaccagcagcggatcgttgattaacggcgcgctgccgcgtagctggcgcacataaaagtcgcccatttgcatctcttgtccaatagaaagcgtgcttcctgccgaggttcccatatcgggcagcgtgtcggcagggtcggcaaatgcgggcgcgacctgaccgagagccaatgctgcaatgagggttgccaccaggttttttttcaactgcctgaacataacctctatcctgttgttttgagatagccctttgaccaacgtcgtgaaatatcgttccacgctccgacacttcataagtgtaactgtgatgagcacagactcactattttagtttcctgaatcaacgataaaaagcgaagtcttttttgtgacatttcgatacaattcggcatcacaatcccgcagttgagttctgggaagggttttatgctcgaaatgttaatgcaatggtatcgccgtcgcttcagcgatccggaggcgattgccttgctggtcattctggtggctggttttagcatcctctttttctttagcggcctgttagcgccgctgctggtcgctatcgtactggcctacctgctggagtggccgacggcgcgcctgcaggcgattggctgttcccggcgctgggcagcctccattgtccttatcctctttgtcggcattctgttattaatggcgtttgtggtgatgccgattgcctggcagcagggtatttacctgattcgtgatatgcctggtatgctgaataaactgtccgattttgccgcgaccttgccgcgacgctatccggcgctgatggatgcgggcattattgatgcgatggcggaaaacatgcgtacccggatgcttaacatgggcgattcggtggtgaaatattcgctggcttcgttagtcgggctactgacgctggcggtatatctggtgctggtgccgctgatggtctttttcctggtaaaagataaagagcagatgctgaatgccgtgcgccgcgtgctgccgcgtaatcgcgggctggcggggcaggtgtggaatgagatgaatcagcagatcaccaactatatccgcggaaaagtgctggagatggtagtggtgggcgtggcgacctggctgggctttttgttgtttggcctcaactattcgctactgttggcggtactggtgggcttttcggtcctgatcccctatatcggcgcctttgtggtgacaattccggtggtgggcgtcgcgctgtttcagtttggtctggggacggaattctggagctgttttgccgtttatctgattattcaggcgctggatggcaatttgctggtaccggtacttttctccgaagcggtgaatttgcatccgctggtgattattctgtcagtggtgattttcggcggtctgtggggattctggggggtatttttcgccattccattggcgacgctgattaaagccgttgtccatgcctggccggatggtcaggtgacggatgcctcatcctgagcggtctgtacaaaagttgtaaagcgtgaacgacatcatagtgccctgccgccattttgcgcacgcctgatgagggtcaagcgcttagaaagccgctcttttttttaatgccgcaccgtgttgcggcatttttattgtcggaacctacaaaattctcgctgtaaagccgccaaaatttggtgacttagcctaagcattcttctgagaaattcgttaataagtgacatcattgatgcgagattgcttttttaatgtgaagcgataacgaaacagggaatgagtgtgttgagaaaacattacttgaaagggtataccgcgcggcaaattgtacagcgagccatgaaaattattccttactcggtaaacgtcatggatgagcatggcgtcattatcgcgtctggcgaaccttcgcggcttcgccagcgtcacgaaggggccattctggcgctgaaggaaaaccgtattgtagaaattgattccgctaccgccaatcagcttaaaggcgtgcgatccggcattaatcttcccatctcttttcatgaacagcttatcggcgtggtcggcattaccggcgaaccggaggaggttcgcgcgtatgccgagctggttaaaatggcggcggagctggtgatcgagcatatggtgctgatcgaacagtgacaatgggataaacgctatcgcgaagagctgatcaaccaattgattttgcgagaaaattcaacagagtcgttgcgctccatggcggcctatctgggcattgatctggcggttcccagagtggtgctgattattgaactttcccagccggatcgcgaagcgctgcgcaatgtaatggattatttcgagaatcacgcgcgcaaccatttggtgacgtttaccgaatttaatgaattaatcattattaagcctatcacgttaaaagagggaaagtggaatacccgccaggaaatgggcgaattgcagatttttaaatcatgggctgcatcatcgggctttagccgtattttggttgggggctattttgccggcgagacgggattgcaccgatctttgctcacagcgagagccacgcaggcgatggcgaaaagacaaaagctgcgcagccagtacattttttatcatgaccacgcgcttcccgcgctgctaagcgggctgtctgaaagttggcaagtgcaggagttatcgcgtctgtggctgcaactggtgcaacatgacgcgaaaggcgtattgcaacagacgctgcggacttggtttgaacataattgtgacctgacgcaaacggccaaagcattgcatattcatgtgaatacattgcgctatcgcttacagcgctgtgaggatattacgcacataaaaatcaacgagttaaaaagtacgctttggctttatatcggtatggagcttcaggccgaatctgtatcgtccgacaagttaccgctgcctggtcgaatcgaaatttgttgaaagctccagcggatttttaggcggttttttccatactgcgcgctccatgttaaaggaggcgcagtatatgacgtcgatatccaccttgggagccattgccgcattggttgtggccatcgtattaattttaagaaaagtgtcgccagcctacggcatgatggcgggcgcgctggtcggcggtttgattggcggcgccgatcttctgcaaaccgtgtcgctgatggtgtcaggcgcgcagggcatcgttaatgccgtattgcgtattctggccgcaggcgtactggcgggcgtattaattgagtccggggcggcgaatacgattgctgagacgattgtccgcaaagtgggggaaacccgggcattattggcattagccattgccacactatgtttgaccgccgtcggcgtatttattgatgtggcggtgattaccgtcgcgccgattgcgctgtcgattgcgcgtaatgcaggcctgtcaaaaagcgctattctgctggcgatggtcggcggcggcaaagcgggtaacgtgatgtcacctaacccgaacgctattgccgcctccgatgcgtttcatgttcctcttacctctattatgctggcgggcgtggttccgggcatcgttgggcttattatcgcctatctgttagcgaaacggctgaataataaaggcgcgggcgtcgccgatcatgaagtgactcaccatgatgactctgtcgccaggcccggttttctggtggcgattagcgcgccgctggtcgctattttcctgctttctctccgtccgtttgtcggcatttccattgacccgttaattgccctgcccgtagggggattggtcggtctgctgttgatgggacgcgcgcgccactgtaaccagtacatggtcgccggtctgatgcgtatggcgcctgtcgctattatgttgctgggaaccggtacgctggccggcattatcgctaattccgaacttaaagatgtcctgattcatggcctcaccgcttcgggattgccgtcctggctgctggcgcccgtgtctggcgccatgatgtcaatggcgacggcctcaaccacagcgggaacggcggtggcgtccggcgttttctctcccacgttacttgaacttggcgtttccgccctggcgggagccgctatgatccatgcgggcgccacggtgctggaccatctgccgcatggcagctttttccacgcgacgggcggcagcgtcaatatgcaaattcatgaacgtttaaagctaatgccgtatgaaacgctggtggggttagccattacctttatttctactctgatgttcggtttctttggttttgcaggataatccctatgaaaattgttattgctcctgattcatttaaagaaagtttgtccgcaatggcggtcgctgaggcgatagaaaaggggttccgcgaaatttatcctgacgccgactacgttaaggtgcccatggcggatggcggggaaggaaccgtgcaatcaatggtggaagctagcggcgggcgttatgttgaccagtgggtacaaggcccgcttgggcaaccggtaaccgcgcgttggggaatgctgggcgatagcgataccgccgtgattgaaatggcggcggcatccgggctgcatcacgtttcgcctgaattgcgtaacccgcttaatactaccagctacggcaccggcgagttaatcgtcgcggcgctggagcgtggcgtaaagcgtattattctgggaattggcggcagtgcgacgaatgacggcggcgcggggatgatgcaggcgcttggcgttatattgcgcgataaacaggggcgctcgctttctccgggcggcgaggcgctggcggcgctggcgtctatcgatttgtccggttgtcacccattgctgcgtaaggtatcgataaccgtggcgtgtgatgtcaacaatccgctgtgtggtccccagggcgcatcggccatctttggcccacaaaaaggggcgacagcggaaatggtgaactccctggacgcggcgctggaaaactggggccgacatatttatcaggcaacgggacgtgaggtgattaacgctcccggcgcgggcgcggcaggcggaatgggcgccgcgcttttagggttgctcaatgcggaattacgcgccggcgtagagattgtcgtggaaacgctacagcttgagcaggcggttaaagatgccgatctggtgattaccggagaagggcggctggacagccaaagtatttgcggcaagacgccgattggcgtcgccagagtggcgaagcggcatcataaaccggttatcgcgctcgccggtgggctgcaacacgatcatcacgttgtgtatcagcagggtatcgatgcggcgctatcgattttgtcgcatatcgttacgctgccggaagccttacacgaggcggaatataacctgagcctgtcggcgcgcaatgtggcggcgatatggcgtctggcgcggcaagcctgacggcgcattccctttccaggccgcacatcagcgcggcctgaggcttttacgcgttttctttcagccagttcagcaccacatcatggtgattgctggttttaaaatcattaaagacgtgctcaatcttaccatcagcgtcaatcaaaaagctgatgcggtgaatgccgtcatacgttttgcccataaacgacttttcgccccagacgccaaactgttcacacacctgatggttttcatcggacaaaagggtaaagttcagcagctctttttcagcgaaacgggagagtttttcaggtttatcggtgctgatgcccagcacgtccacgcctgcttttttaagctcgtccatgttatcgcgtaagccgcaggcctgcacggtacagccgggtgtcatggcttttgggtagaaataaaccagaacgcgctgcccctggaagtcggtcaaatttacttgttccccgtcttgatccggcaagctaaatttcggtgcgatatcaccggctttcagtggattcattacttaactccatcctgttcatcatgttgtgagtaattgacgacgtttatactgccttgcgcattgagttctgtacatagtgctttaaaggcttgctcaatatttgcggaattttgcgacgccgggctatgtgcggtgatttgaataaataattgcgcagctttatcatcttcagccggctgcgtgcgggagaccagctccgcaatattcatttcatgactattaaacagcgcggtgaatcgctcaattaaatgcggggagtcggcgacctcaacctgaacccataccgtcgcgggcattgccgggcgggggcggtcggacgtccgtttcatcacaatcagcagatccagctccgcgccttttaacggcaatgtcgattcaatcaaggtaatcgcgttccacgtgccggacaacagcataataaacgtgaattcatcgcccagcatcgccagtcggctgtcttcgatattacagccgcaactgctgacatggcgagtaatggtattcacaataccgggcctgtcggcgcccagcgcagtgataaccaaatagtgttgtgatgacggtgtcaaaccagttattcctttgagcggtgaggtaatcttaaggaaaccataaaaaaaacctgcatacaacaatcagaacggctttggtcgcttgcttttattgtcataccaaacgtaccattgagggacttgtttgcacagaggatggcccatgttcacgggaagtattgtcgcgcttgttacgccgatggatgagaaaggtaacgtcagtaggtcttgcctgaaaaaactcattgattatcatgtcgccaacggtacctcggcgattgtttcggttggcaccaccggcgagtctgccacgctaagccatgatgaacatggcgatgtcgtgatgatgacgctggaactggctgacggacgtattccggttatcgctggcacgggcgcaaacgcgaccgcggaagcgattagcctgacgcagcgttttaacgatagcggcattgttggctgcctgacggtaacgccgtactacaatcgccccacgcaggaaggtttgttccagcatttcaaagccatcgcggaacacactgacttgccgcaaattctgtataatgtgccgtcccgtaccggttgcgacatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtccgcgctggactttatgcaactgggtggtcatggcgtgatttccgttactgctaacgtagcggcgcgcgatatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcaccgaccatggtcgtgacatcgtcaaagcagcgcttcagcatgctggcctgctgtaaagtttagggagatttgatggcttactcagtacaaaagtcgcgcctggcgaaggttgcgggtgtttcgcttgttttgctgctcgctgcctgtagttccgattcgcgctacaagcgccaggtaagcggcgatgaatcctatctggatgccgcgccgcttgctgaacttcacgccccggcaggaatgattctgccgataacgaccggcgactacgttattccggtcacgaaggggagcggcgcggttggtaaggcgttggatatccgtccgccggcgcagccgttagcgttagtgagcggcgcgcgtacccagttctctggcgataccgctacgctattggtggaaaatggccgtagcagcacgctgtggccgcaagtcgtcagcgtgattcaggcgaaaaattatccgattgaaaaacgtgacgatgccagccagaccctgacgaccgattgggtgagctggaaccgcctggatgaagacgaacagtatcgcggacgttatcaaatctcggtgaagccgcagggctatcagcaggcggtaacggtaaaactggttaatctggaacaggctggcaagccggtcgctgatgcggcgtcgctgcagcgctatagcactgaaatgatgaacgtcatttccgccggtctggataagaccgctacggatgcggcaaatgccgcgcagaaccgttccgccgcaacgatggatgtgcagagcgccgctgatgataccggtttacctatgctggtcgttcgcggtccgttcaacctcgtgtggcagcgtctcccggccgcgctggaaaaagtgggcatgaaagtcaccgacagcactcgctctcagggcagcatggcggtaacgtacaaaccgttgtctgacagcgactggcgggatctgggcgctagcgacccgggcctggcatccggagactataaattgcaggtcggcgatttagataaccgcagcagcttgcagtttatcgatcctaaggggcatactctgacgcaaagccagaacgacgcgctggttgccgtcttccaggctgcgttcaacaagtaatttaacagggctggagcaatccggcccttttttctgataagatacgcaaacgtgtgcgtcggtacaaaaacgcgatttaaccgctatttcgcaccacaattacaggccggcgtctctggcaggcgtagcaggaaatgaatacttatcgttaattcacacccaggagtgttaaagatgcaaaagcaagctgagttgtatcgtggtaaagcgaaaaccgtatacagcacggaaaacccggacctgttggtgctcgaattccgcaatgatacgtcagcaggggatggcgcgcgcattgaacagtttgatcgcaaaggcatggtaaataacaaattcaaccatttcattatgaccaaactggccgaggcgggcatcccgacccagatggaacgtttgctgtctgataccgagtgtctggtgaagaagctggagatggtgccggttgaatgtgtggtgcgcaaccgtgcggcagggtcgctggtcaagcgtctgggcgtggaagaaggcatggagcttaacccgccgatcttcgatctgttcctgaaaaacgacgcgctgcacgacccgatggtgaatagttcctactgtgaaactttcgggtgggtaagccaggaaaatctggcgcgtatgaaagagctaacctacaaagccaacgacgtactaaaaaaactgtttgatgacgcgggtcttatcctggtggatttcaaactggagtttggcctgtataaaggcgaagtggtgctgggcgatgagttttcaccggacggtagccgcctgtgggataaagagacgctggacaaaatggacaaagaccgcttccgccagagcctgggcggtctgattgaagcctatgaagccgttgcgcatcgcctgggcgtgaaattagattaattccgcttctgaccgggggggcaaccgctctccggtatcatcctttcctcattctgatagcgtttacctgtggtaatcctgcgcctgaccgcctacgatcatctgtataacaaagagagaatgaggtgattatgcgctggcaagggcgtcgtgaaagtaacaatgtagaggacagacgtaatcggccaggcggcccctcgctgggtggccctggctttcgtcttccgcgcgggaaaggcggcatcattctgttggtggtggtggtggtcgcagggtactatggggtggatttaaccggtctgttgactggtcagccggtttcgcagcagcagtcgacgcgttcgataagccccaatgatgatgaagcggcaaaatttacctcggtgattctggcgacgaccgaagatacctgggggcaactctttcaaaaaatggggcgcggctatcagcagccaaaactggtgatgtaccgtggtatgacgcgtaccggctgtggtgcgggtcagtccgtgatggggccgttttactgcccggcggacggcaccgtctatatcgatctctcattttacgatgttatgaaaaataagctgggcgcggacggtgattttgcccagggttatgttatcgcccacgaagtcggccaccacgtacaaaaactgttaggcattgagccgaaagtacgccagttacaacaaaacgcgtcgcaaacggaggtgaatcgcctttcggtgcgcatggagctacaggcggattgctttgccggcgtgtggggacacagtatgcagcagcaaggcgtactggaggcgggcgatctggaagaggcgctcaatgccgcacaggctatcggcgacgatcgcttacagcaacaggggcaggggcgcgtggtgccggatagttttacccacggcacctcagaacagcgctacagctggtttaagcgtggatttgacagcggtgacccggcgcaatgtaatacgtttggtaaaaacttttgataaactggggcagggatgtctgatatcgatgcgctacgggcgttaacgtcgcaaatgacacaggaaggcattcgccgtttactggtcatcagcggcgatgcggcgtggtgccgggaacgggccgaggcgatacgcgctgtattgcccggtgactggtgggtcgcgcctgacgcgcccgcccagccgcgctgtacgccacaggcgttacaaacgctgctgggccgtgaatttcgtcatgcgatatttgatgcctggcagggctttgacgccgcagcgtttgccgccctgagcgggaccttgcaggccggaagttggctgcttctgctgatgccgccgtatgagacgtgggaaagccggcctgataccgattcactgcgctggagcgactgcgcgcagcctatccccacaccgcagtttgcacagcatcttaaacggactctttcccgcgatccgcaaacgctgctttggcgacagcgccagccgttttgctggccatcttatccttcccgcgaacgctggcgacccgccaccggcgagccgcagccggagcaggcggctatcttatcgcgtttacgtgaaatgccgcccggcgtggcgacggtgattgccccccgtgggcgcggcaaatcggcgctggccgggcaattcatctcacagatggcgggcacggctatcgtgaccgcaccggcgaaaacggcaacggatatcctggcagcgtttgccggtgagcggttctgctttatggcgccggatgcgctgctggcgagcggggcaagagccgactggctggtggttgacgaggcggcggcaatccccgcgccgctgctgctgcaactggtttcgcgctttccccgcatactactcaccaccaccgttcagggctacgaaggcaccggacgcggttttttacttaagttttgcgcccgttttccgcagcttcaccgctttacgcttcgtcagcctgtccgctgggcgccagaatgcccgctggaaaatatcgtcagcgaggcgctgatattcgacgatgaagcgtttgcgcaggcgccgcatggcgggatagcaatctcggcattttaccagcaggcctgggggaagacgcccgcgttgccgagggctgtgtatcagttactgtcgggggcgcactatcgtacttcgccgttggatctgcgccgaatgatggatgcgccaggacagcatttcttgcaggctacggcgaataaccgtgtggcgggcgccctctggctggtcgaagagggcgggttatccgcagagctcagtcaggctgtatggtgcggtttccggcgtccgcgtggaaatctggtggcgcagtcgctggcggcgcacggtagcgaccctttagccgcgacgctggtcgggcgtcgcgtaagccgtatcgcggtgcaccccgcccgtcagcgcgaaggcatcggtcagcagttgattgcctgcgcgtgcgagcaggcggcgcagtgtgattatctttccgtcagcttcggctatacgccggagctgtggcgcttctggcaacgctgcggctttgtgctggtacggatgggcagccatcgggaggcgagcagcggttgctatacggcgatggcgttattgccgctgagcgacgcgggacaacggctggcgcaacaggaacaccgacgtttgcgccgcgatgcggatatcctgacgcagtggaacggcgaggcgataccgctggcggcgttgcgcgaacaggcgcttaatgatgaagactggcgtgagctggtcggttttgcgttcgcgcaccgcccgctactgacatcgttaggttgcctgcatcgtttactgcaatacagcgcattgccattgccggcgctgagagggcggctggaggaaaaagccagcgatgccgaactgtgcgcccggctacgcatttcaggccgtaaagctctgctggcgttgcagcgtgcgcaggcggcgcaggcgctaattgcgttggatgccggacgaacgcagcgtttgcgcgacgtaatgccaggcggtggggaccatgccggatagcgatacctgtccggcatgttatccggttactttttcggctgatctttcttcggccagtcgtcttcatcgtcccacttatcgttaaaatcgcgatgcgggggcagctcaggtttgttggcaaggaatttcttatggtcgatgcgtttgagatctttgatcacattcagcagtacgcctaccagaaacaccaataccagaatccaccaatattttgccagccagtccatgcttatttcctcttaccggaacgctcatcaggcgacgagctgttccataatacgttgatacatacgggccagtagctggagatcggcggcattcacacattcgttaattttatgaatggtggcgttcaccggccccagttctaccacctgcgctcccatacgggcgataaaacgtccgtcggacgtaccgcccgtcgtcagtaattgcggtttaatttcattatagtgctcaatggcgtttaccaccgcgtccaccagctttccgcgtgcggtcaggaacggctgaccggaaagccaccagtctacggtatagcgtagctgatgcttctcaagcagcgcatgtacccgttctttgatcatctcatcggtcagctccgtgctaaaacggaagttaaactgcacgaacagttcgccgggaatgacattattgctgccggtgcctgcctggatattggctatctgcatactggtggccgggaaaaagtcattgccccgatcccactcgatagcgaccagttcattgagaaaaggcgcggcgcgatgaacagggttatccgccagatgcggataggcaacgtgcccctgaacgccatgaatagtgaggttacaggtgagggaaccgcgacgcccgtttttgacgacatcgcccacaatttcagtactggaaggttcgccgaccagacagtaatccagccgctcgttacgggccatcagcgcttcaaccacctttacggtgccattttttgcgctggcttcttcatcagaggtaatcaaaaatgcgaggcggccccggtgatgaggatgctgtgcaacaaaacgttcagcagccaccaccatggccgccagtgaacctttcatatccgccgcgccgcgaccgaacaacattccgtcgcgaatcgtaggttcaaacggcggattgatccagcgatcgacatcgccagccggtacgacgtcagtatgcccggcgaacgccagcgtttcgccacgcccacgccatgcccaaaaattttgcgtgtcgccaaaatccatatgctcaatggtaaaaccgattttacgcaggcgttcaatcattaatgcctgacagcctacgtcatccggactcagggaggggcgacgaataagttgctgtgtcagctcaataaccgggcacgacatagactacacctcatcaaaaaactgctgataacgggattcactgaaaccaagcagcataggcttcccgggcgcgcagagcaatgggcgtttgatgattgccggctgttcaaccatgagagcagcggcggagtcggcatcggtaatcccgctgcggtggccttcatccagtttgcgccatgttgtgccgcgcgtattcagtaaaggctgccagccgagttcggcaataaaggtattaagaagagggaggtctatgccatccacacggtaatcgtgaaaacgataatcaatgccatgctcctccagccaacggcgcgcttttttgatcgtgtcgcaattcttaatgccatagagggtaatcatattgaatcctttaacgcgaaattcgaataaataatcaatagtatcgtctgcgggataataagtgtggctgttaatggttatttatccagcgctgatcggcaatcaatataacattgttgagtgaatgtgaataatgattccaaaacgttccagatgtggcttgtttataattcgtgaggaaaatcctattttgcgcacatgcaattgattgttttttaacccgatttgataaagtagtagaaaaggtattaatgttgctaaatattgcagtaagtcacataaaatttacggctacagcgccatagtaatatcatagacagcataaccagaggatatcgcaacaatcggttaaatgaacttctctctataccgctaactacgtagaatacccataataataagagaggctattatgattgaacgtgaactggggaactggggaactggggaactggggaactggggaactggggaactggggaactggggaactggggaactggggaactggaaagattttatcgaagtcatgcttcgtaaataaatgcctggaaggcaccgcgctcccataggggataagaaaaggcgactcaacgaaagtcgccttttttgtgcccgacacctcgtatcaggctggccaggagcttattccgggcgcggcttcagcgggaagcggcgacgtatcagcacgaaaaacaggggtacaaagaagatagccagaatggttgctgagatcattccccccatcacgccggttccgacagcatgttggctacccgagcctgccccggtgctggtggccatcggcaatacgccaaagataaacgccagcgaagtcatcagtatcggtcgcaggcgctggcggctggcgtacagcgtggcgtctaacagcgcgtgtcccttctgattcatttcgttggcgaattccacaatcagaatcgcgtttttcgccgagaggccgataacggtcaacagccccacctggaagtaaacatcgttttccagcccgcgcatccaggtggcgagtaacgcgccgatgaccccgagcggcacaaccagcatcaccgagaagggcaccgaccagctttcatacaatgccgccagacacaggaagacgactaatagcgaaatagcgtacagcgcaggcgcctgcgcgccggagagccgttcctggtaagacatggctgtccattccaggccaaaaccgcccggtagctgatgcaccaacgactccatgacatccatcgccgtcccggtactgacccccggcgcggcctctccgacaatttctaccgccgaatagccgttatagcgttccagacgcggcgatccggtttcccagcgcgaggtggcgaaggcggagaaggggaccatgccgccgtctttgttacggacataccaaagattaatatcgtccggcaacatacgatatttcgctgcggcctgaacatagaccttcttcacgcggccccggtccataaagtcgttgacgtagctcgatccccaggctgtttgcagggtgtcgttgatatcgtcaatcgatacgcccagcgcctgcgctttccgttggtcaatatcaatttgcagttgcgggctgtcgtccaggccgttgtggcgcacgcgggtcaaggaactgtttttcccggccagctcaatgagttgatctcgtgcggccatcagcgcgtcatggcctgctccggcgtgatcctgtaattccatatcaaaaccggcggagctgcccagaccgctaattgccggcgggctgctggcgaagacgcgagcttctttaatctggttaaatgcttttgtcgcccgctcaataatggcgaacgaggagccggtggtgggatcgcgcgcgtcccagtctttcaagcgaacaaacatacgcgcgacgttttgcccgttcccgccagggccggaaccgaccgtcgagaagaccgacataatgttgtttttctcatgggtgaagtaatagttttcaaccttttcaacgactttcagggtctgctgttgcgtagagccgctcggtagctggatagacgtagtgaacatgccccgatcttcttgcggcagaaaggaggtggggagacgcaaaaacaggaacaccatgccgccaagcaacagaacataaatcagaatccagcgcaggctgcgatgcaaaattttcgctacgcctttctcataacgttcggcattacgattgaaggtacggttaaaccagccgaaaaatccgcgttgcccgtgctgttcgcctttgtgcagcggttttaataacgttgcgcacagcgccggcgtcaggatcatggcgaccagcaccgacagcaccattgccgagacaatggtgatagaaaactgacgataaatcgccccggtggtaccgccaaagaacgccatcggtacgaataccgcagacagtaccatcgcgataccgaccagcgccccctggatttgtcccatggatttgcgcgtcgcttcacgcggcgtgagcccttcttcgctcatgatacgttcgacgttttccaccaccacgatggcatcgtcgaccaggagcccgatcgccagcaccatcgcgaacatggttaatgtgttaatactgtagccgaacgcgtaaagcacggagaaggtgcccattaatactactggcacggcgatcgtcggaatgagcgtggcgcgaaagttttgcaggaacagatacatcaccaggaaaaccagcgcgatagcttccagcaacgttttgaccacatcgataatcgaggctttgacaaaggaggtggtttcatacgcgatcttgtattccaggccgtgagggaagtactgcgccagctcgttgaggcgatccagtaccagcttcgcggtcgccatttcgttcgcgccggaggccagcttaacgccaaggccggaagccggattgccgttaaaacggctgaggtagtcatatttttccgcccccagctccacggtggcgacatcgcccagtttgacctcggaaccgtcctgattaacgcgcagggtgatatcgcgaaattgttgcggcgtttgcagcagcgactgcgcattgatggtggcgttcagcgcctgcttgtcgaccgaaggcgtaccgccaagctgcccgacggcgatttgcgcattctgcgactcaatcgcatcggtcacgtctttcgtggtcatctgaaaactattcaatttggccggatcgagccagatacgcatagagtactgtgaaccataagcgtcaatatcgcccacgccgttgacgcggctgagcgggtcctgaatattactggcgacgtagtcggcgatatcctgcttgtccatagaaccgtcggtagagacgaaagcgatggtcaaaatattggtatcgcccgttttgcgtaccgtgacgccttgatcctgtaccgcctgcggcagtttacgcatcgcggactgtaactggttttgcacctgctgaaccgcctcatcaggatcggttcccgcaatgaagctcagcgtaatggtcgcctgtccggttccgctgctttgtgatgacatgtacatcagattatcgaggcccgtcatattctgctcaataacctgggttacggtattttccagcgtttgcgccgacgctcccggataattcgcggtaatacgtacgttgggcggcgccagatcgggatattgttcaacaggtaaagaaaaaatggctaacgcccctgtcagacacaacaggatagccagcacccaggcaaaaatggggcgatcgataaaaaaattcgccattaaaggggaacctcgtgtttctacatatcgttatagatttgaactgcttcactgtagcggcaagctacgagccaaacgtggagaaataaaggagataatgtaaattatcatgcgcttttacagcatactttttgtgccaacgccggaaagcctgacatctggccttccggtgatttgccgttctttacgttaactgactctcttccttgttggaggagcgaaaactgatactgaccagcgtgccgccgccggagggttgcgaaaaattcagcgtgccgccaagccgttccgcgcgctcacgcattatattcagaccatagtgtccggcaggctcatgcggttcgccgataccaatgccattatcgcgaatataaacggtatgatcgccgtcaggcgcggtgacgcagctcacggcgatttcgctcgcgttggcgtgtttaatggcgttcaggacagcttcacgcacaatttgcaataaatgcacctgcatttgcgcatccagcgccagcgtgggtaaacggcaatccaacttgagtttagccggagtctgactctgtaaatcttccagcatctcatgcaatgcggagggtaaatcggcctgctgtaacgtcagacggaacgtggtgagtagctcgcgaagctgacggtaggcgtcgttcagcgctctggaaaaatccgccatgatgctttgcgcgccggcgttatcttctggaatggcgcgcttcaaaagcgttaattgaatacgtaaataagaaagtacctgcgccagcgaatcgtgtaactcacgggcaatcgtcgcgcgctcttccattaacaaaagttgctggaagtgtttttgcgcctgattaaagtacaaaccacgccccagcatcgtggagacgctgttcagcaacggcgtagaggcattaacgttggggctttgccagtggagttcgccatagaccgtgtcctgcatcgtcactggcagcatttgcatcggcaggtcggggctttgcgtgccttcgctaatccgccagttatcgcccacggttaactccagataccaggcggcgtcatgttcacggacaatttgcaaaatatggcgaaaacagtggacatcgatttggctggtattcagcgcctgggagcactggtataacacctccaggcggcggtgcgcttcgtgcagatcgtgcgttttttcttccaccgaggcttccagcgaacgataaagtttatgcagctcgctcgacatctgactaaacgttttcgccaacaatcccagctcattgggtaagctggtatccagcggcagcggggcgaactgaccatgttcaattcgctgactggcggtgaccagttgattcagcgggcgaacgacctgctggcgaatacgccgtagggtaaaaaagaccagcgtaaatatgccgataccgcccgccagcgatatggcgacgaccagcatgactttacgctcggcgtaatgctgtaacgccagaacgaagagatcaatttgatcgacgtaattgttgatattggactgataccagacaatgtcgccatcctgtaggcggctattcatctccagccagttggcgtgcaggcgcgcgtagcgagttttcaccgcctgcggcacataccaggcgttgagattttgcagtaccggcgagttgagcgcgtgctggaaaagttgacgatgcgcattaatctgcgggctacggctttgcagatcgtaacccagccgatagctctgcattcgtagcgaaccggcgatattgatcgcttcggcatcccgtaaactgctggtcagcgtcagtaatgcgctgccggtggacagaatagacaacagcacaatatagaaaaaagccttagccagactggccgagaccgggcgtttaaccgtcacactggtactccccgcatttagctgaaccgcaatttcatttgctttgaaataaattgatctgccacaggttctggacagatagttgtgcttcctgggcagatgaacattgccgaccccgccttcgtcagttaataacaatgctcatataaagaataaggtttttgcaaccaaaacagaaggacgccatgaatcgttttattatggccaatagccagcagtgtctgggatgccatgcctgcgaggtcgcctgcgtaatggctcacaatgatgagcgacatgttctgacgccacagcgctatcagccccgaattactgtcatcaaacatcagcgccagcgcagcgcggttacatgtcaccattgcgaagatgcgccctgcgcccgtagctgtccgaacggcgcgatcgcgcatattaacgacagcgtgcaggtcaatgcgcagaagtgcatcggctgtaagtcctgcgtcgtcgcctgcccattcggcaccatgcagatggtattgacgcccgtcgcgccaaaccagttcaaagccagcgcgcataaatgcgatctgtgtcagggacgtgaacagggtccggcctgtgtggaaaattgcccggcggatgcgctgcaactggtcaccgaagactcgttgacccgtctggctaaaacgcgacggctgcgtaccgcccggcaggagattcgcccctggcataccgtggatacacaacacagtgggacagcatgcagcaaagtcgagcgtatgcaggcgacgccgccgcgcggcgaaccggataaactggcgattgaagcgcgtaaaaccacctttgaggaaatttatctgccgtttcgcgccgcgcaggcggagcgtgaagcggcccgctgcctcacatgcggggaacacagtatctgcgaatggacctgtccgctgcataaccatattccccagtggatcgaactggtgaaagccggcgatattgatgcggcggtagagctttcccaccagaccaactgtctgccggaaattaccgggcgcgtctgtccgcaggatcggctatgcgaaggcgcgtgtacactccgcgatgagtatggcgcggttaccatcggcaacattgagcgctatatctccgatcgcgctctgagcaaaggctggcgtcccgacctgtcggacgtacagaagagcgataagcgcgtggcgattatcggcgcggggccggcaggtcttgcctgcgctgacgtgctggcgcgccgtcgggaaatcttcagcgcgatggggattcgtttcgaacttaactgcgaagtagggaaagatatttctctggagacgctgctggagagttatgacgccgtctttgtcggggtaggaacctatcgttccatgaaggctgatttaccgaatgaagacgcgccgggggtatatgatgcgttgccattcctcatcgccaataccaaacaggtgatggggcttccggcgttgcctgacgagccgtttattgatactgcgggccttaacgtggttgtgctgggcggcggtgacaccgcaatggactgcgtacgtacggcgttgcgtcatggcgctgccaacgtcacctgcgcttatcgccgcgatgaggccaatatgccagggtcgaaaaaagaggtgaaaaacgcgcgggaagagggcgcgaactttgaatttaacgttcagccagttgagttggtgctggatacgcacgggcgcgccagcggtattcgctttttgcgtacgcggcttggcgaaccggatggtcaggggcgacgccgtccggtacctgtaccggacagcgagttcgtgatgccggcggatgcggtcattatggcgtttggttttcatccgcatggtatgtcgtggctggaatcgcatggcgtgaaggtggataactggggacgtattgccgccagcgtcgagagcgagtttcgttaccagacgtccaacccgaaaattttcgctggcggcgatgcggtgcgcggcgccgatctggtggtgacggcgatggcagaaggccgacatgccgcgcaggggatactcgactggttagctaaataagcgtatttgtaggccggttaaggcctggaacggttaaatgatttagtgataaaaaatcttaaacttattggctaaccttactccgtttgcagaaatgttgacgctcgcagggctggacgccctgcgataaacattttcccgctgggtcgatgtttaacaggcctgataaggtcaatcttagtattgaaaatagagtgtaaattgaaggaagggacgctatcagaatcccttcttagagcctatcccattagggctattttacgtgccattttggacctgggcagtgctcgccaaaacgcgttagcgttttgaacgccgcttgcggcggcccgaaggacgagcgtagcgagtcaaacctcacatactacgtgtacgctccggtttttgcgcgctgtccgtgtccaaactggctgcgccaataacgtctggtgggataggctcttaatttttattttaaggaaccatatatctggtcaacaatccagccatacgtcgccgcaggtaataatccactgacaaaaacattcgggttcactttaggatttgctaccggcgagtgcggcctgttacctaaaataacaatcgccatatgattaaccggatcgatagacgtcagcgttccggtccatccggtatgtccatacgtttgcggactggctaataccccgaacgttggggtcattgaggcgttgccgttaacgcgccaccccagaccaaaggtagcatcttctggcgagcggcgagtaaactgcgcaaccgttttgttgtcgaatagcttcacgttaccgtagccgcccccattgagcatgacttgcattaacacagccatatcatgggtgtcagaaaacagtccggcgtgtcctgaaacgccgcccattgagtaccaggctttttcgtcatgcacctggccccatagtgtattggtgcgaatattggggaaatgaatcacgccgtcacgcgtgttgccgtgtagttccgttgcggcgatttgcggcggcgtgaagcctttcatcagcgggttaaagacggtatgttttaatccgagcggtttataaatggtggtttcgacgtagcgatctaatggcattgccgttatcgattcaatgataaaaccaagaatcatataatccacgtcgctgtagatatgcttcgacccaggttgatattccagcggtgtctttttaatcatctccagagtagtgcttttactctgtgaaaataatttaccggcgacgtttttattgggatattgtgggtcggcaggaaagcccgcgacgtgatgaagaatatcaataatgcggagtttatctttgccttttattttatccccaggcatatccttaaagccggggatatattttgataccaaatcattgacatctatttttccttcatacaccagtttttgcaatgcaaagttagtggcatacatttttgtgtttgaagccaggtcatacatcgtgttagtggtcgcccgaatgggatgggctaacagcgtggaaccgtcatattttttggcatagccccaggctttttgtagaacaatatgattatcttttatcaccagaagattgatgctgggatatccggcatcaatttgattttgaatccagccatcaagtcggtgaagtttttggctatcaaaccccacctgatcagggctcgcggtggtcaataccggatactcaacggcaaaagctgaaagggaaaacgtcagtagaaccgtcgcaacgagagtaaatttcatgatgattccctcagtctcactccggccgtcaaatcatatcgcgagcatggactctgcggcccggagaagcagaatgtggtcatggcagtgacagaaaaatatggctgtacatccgttcagtcggcattaaggattaacccttcagcagacaaaaccgacctcacggcgtaatattaatgctctttttacaccctggagccagcatgtcgcaaaccattacgcttattaaggataaaattctttctgataattattttactctgcgcaacattacctatgacctgacccgtcgtaatggcgaggttatccgtcacaagcgtgaggtttacgatcgcgggaatggcgcaaccattctgctttacaactcaactaaaaaaaccgtggttctggttcgccagtttcgcgtggcgacatgggtcaatggtaatcaagacggtatgttaattgaaacctgcgctggcctgcttgataacgacgagccggaggtctgtatccgtaaagaggccattgaagagacagggtatgacgttggtgaggtacgcaagatatttgagctgtatatgtcgccaggcggcgtcacggagctgattcatttcttcattgccgaatatcatgatagcgagcgtgccagcatcggcggcggcgtggaggacgaagagattgaggtgcttgaactaccgttttcccgggcgctggaaatggtgcgctcaggcgagattcgggacggtaagaccgtgttattgcttaactatttacagacgtctcatctaatggactgaaaaaaaagaaatatatttctttacacaaaaaagaccaatccgataaatctgattgagaaccctgaggcgcgcaaggaagataccgcctgagctgtgttgttctgaatctggggttgttccgttcatgcgctaccgcgttattcttttttgtctgtttggcctgttgccggtccagctactgtgggctgcgccagcgcaacggactttttccgactggcaggtcacctgcaataaccaaaatttttgcgtagcgcgcaatactggcgaacatcatgggctggtgatgacattaagccgcagcgccggggcgcgtaccgatgcggtactgcgtatcgaccgcggcggtttggcgccgcccgacgctaaagaagccgcaattgcgcctcgcttattgctggatggcaaaccgctttcgttcaacagttcacactggcgcgtgtcgccctggcatctcatgaccggcgatcctgccaccatcaccgcatttttacagacgattcaggatgcgcaggccatcaccttaaaaaacggcgttcagacgctttcgctggcgggattaaaagcggcattactgtttatcgacgcgcaacaaaaacgtgtgggcagcgaaaccgcctggattgaaaaaggaaacgaaccgccgctcagcgtgcccccggcaccggcattaaaggggatcgccgttattaatccaacgcccgtaccgctgagtgaggaagaacgcgacgatctgctggactacgccgcatggcgggtaaacggcattcgttgttcgcttgacccgctgcgtcgcgagacgcaggtcagcgcgttgacggatgataaagcgttattgattgttaactgcgaagccggcgcctataacactattgatctcgcctgggtagtttcacgcaaaaaaacgctcgtctcgcgcgccgtacgtttgcggctgccgtttaatcgcggcgtcgaaagtaatgacatggagttgatgaacgccttctttgacgagaaaacgcgcgagctggtgacgttggcgaaagggcgggggttaaccgactgtggtatccagacgcgctggcgctatgatggcgatcgttttcgtctggtacgttatgccgaagaaccgagctgcgatagctggcacgggccggatgcctggcctacgctgtggatcacgcgttgaatcctggttgttatccccttttcagaatagggatacacctattgaggtttcatttatggtatagagattgctacgttacggtaggattgttactttacccgatagcctcaccacagcaggaaatagtatgaaaataaataatggccccgtattatgcccccattgtggctgcctgagcgcttattatgaaatagatcggctggcggcgataagagaaaaagtgaataaagaaggcggatcagcggcgtgggattcaacattgcaggcgcataaaaaaaaggccttttgcctgatgtgccataaatccattgatgaggtcgtcatcgggcagtcagatgcgcctgagtctacgaagtaattttgcacagcctacagaacaggtctgcagactgtgcaaagtctgtgttgctaacgcccgccttagcctttgatgttcagcacccggcgggctttttccacaatattttccacggtaaagccaaaatacgggaacagtttgtcagccggggcggattcaccgtatcccgtcatgccgataattgcgccttttaggccaacatatttataccagtagtcggctataccggcctccaccgcgacgcgggcggttacgtgcgccggtagcactgattcgcgatatgcctcgtcctgcgcatcgaaaatatccgttgaaggcaacgacaccacccgaacgttatgcccctcgccagtcaatttttccgccgcctggagggtaatttccatttccgatccggtagcgatcagaatgatatccggcttgccgccgctatctttcagaatataaccgccgcgggcaatcgctttcacctgttccggcgtgcgttccacctgcgccagattctgccgcgagagaatcaacgccgtcggcccgtgctgacgttcaatggccagcttccaaccgactgccgcctcaacctgatcgcagggacgccaggtgctgaagttaggcgttaagcgcaggctcgccagttgttccatggcctggtgcgtcgggccatcttcgcccaaaccgatggagtcgtgggtatagaccataatctgccgggctttcattaaggccgccatacgcgccgcgttacgcgcatattcgacaaacatcagaaacgtggcggtatacggtacaaagccgccgtggtgggcgatgccgttggcaatggcggtcatgccgaattcgcgcacgccatagtggatgtaattacctgccggatcctctttcaacgaggtcaaacctttccagatagtcaggttgctcggcgccagatccgccgatccgcccaacagttccggcaacaggggaccataggcattgagcgtattttgcgatgctttacgggtggcgattttggccggattagcctgcaagtcgttaataaatttttgcgtggcggattcccatgcctccggcaatccgccgctcatccggcgggtaaactccgcggccagctcaggataagccttctcataagcagcaaacttttcctgccactgctgctgcgctttctcgcctttttcacggccatcccacgcgcggtaaatctcttttgggatctcaaacgccggatgatgccatcccagcttctggcgggtcagcgccacctcttcttcgcccagcgccgcgccgtgcgactcctccttcccggctttattcggcgagccaaaacctatcaccgtccgacagataattagcgaaggtttatcttttacgctctgggcttccagaatggcttttttcaccgcctccggagcgtgcccgtcaatgtcatgcacgacatgccagtggtaggcttcaaaacgtttggctgtatcgtcggtaaaccagccttcggtttcgccatcaatggagatgccgttgtgatcgtaaaagccgatcagtttgcccagtcccagcgtaccagccagcgaacacacctcatgcgagatcccctccatcagacagccgtcgcccataaagacataggtgtagtggtcgacaatctcatggtccggccggttgaactgtgcgcctaacgtacgctcggcaatcgccagcccgacggcattcgccagcccctggcccagcggcccggtggtggtttcaacgccaggcgtatagccaatctccgggtgaccaggcgttttagagtgcagttgacggaagttttttagctcctccagcggcaggtcatacccggttaaatgcagcagactatagagcagcatggaggcgtgactgttggaaaggataaaacgatcacggtcataccaggtcggatcggtggggttatgtttaagaaaatcgttccatagcacttcagcgatatccgccatccccatcggcgcgccggggtgcccggaattggctttttgaacggcatccatgctcagcgcacgaatcgcattggcaaggtctttacgggacataaatcactccatgcaaggtttatagtttggcggcaagcaggtcttccagtttgcgctggtcaacggcgaaaaggcggataccttccgacagcttctctacggccatcgcgtcctgattatgttcccagcggaactccgcttccgtcattggcgtaggacggtggaacatctgcgaggaaggcaccagtttacggatcaccggttcttctttttctttcagctctttaagcaggttaggggagatagtcagtcgatcgcagccggttagcgcgaggatttgctcagtacggcggaaacttgcacccatcacgatggtttcatagcgatgctgtttaaagtaatcgtagatattgcgtaccgatttcacgccgggatcttcctccacgacatacggctccagcggactacgcgcctgataccagtcgtaaattcggcccacgaacggagagattaaatagacgcccgcttcggcgcaggcgcgcgcctgggcaaaagagaacaacaacgtcaggttgcaattaatgccttctttttcgagctgttcggcggcgcgaataccttcccaggtcgcggcgagcttgatcagaatgcgtgatttatcaacatcctgctgctggtagagatccaccagatggcgtgctttctcgatacttttttctttatcgaacgataaccgcacgtcgacttcagtggagacgcgaccgggaatacttttcagtatttccgcgccaaaattaaccgccagtttatcgctggctgccgcaacctgctgttcctgcgtaccgccgtgtttttttccccaggcaatcgcatcctcaatcaaatgaccatactgctcaagcccggcggcttttaacagtaaagagggatttgtcgtggcatcctgcggctggtagtggcggatggactcgatgtcgccgctgtcggcgacgacggtagtgaattgtttgatgccgtctagctggttcataggaaatactccttgaaaagtaaagtgttagatgagtgtgttgattcacacttctgaaagattgatacactacataaccaaaaagcatagcagacaggcatggtattgctggtataagcaggtaacatggctgttataagttgataacaaactcttgcgccgcgtcgtgatagtttgcagaccttcaaagtttgtgttgcgcagtacggtgataatgtgcggcgcaccaggccgcgtcactttttgaacgatacgtgaaaggaacaacaaaatggatgagcagttaaaacaaagcgcccttgatttccacgaatttccggtacccggtaaaattcaggtttctccgactaagccccttgccacccaacgcgatctggcgttggcttactcgccaggcgtggcggcgccctgcctggaaatcgaaaaagatccgctggcagcctacaaatacaccgcgcgcggcaaccttgtcgcggtcatttccaacggtacagcggtgctggggttaggcaacatcggcgcgctggccggcaagccggtcatggaaggcaaaggcgttctgtttaaaaaattcgccggcatcgatgtgtttgacattgaagtcgatgagcttgatccggacaaatttatcaatgtggtcgcagcgctggagccgacctttggcggcattaacctcgaagacattaaagcgccggaatgtttctatattgagcagaaactgcgcgagcgcatgaacatcccggttttccatgacgatcagcacggaacggcgatcatcagtacggccgccattcttaatggcctgcgagtcgtagagaaaaatatttccgacgtgcggatggtcgtctccggcgcaggggcggcggcaatcgcttgtatgaacctgctggtcgcgttggggatgcagaagcacaacatcgtggtgtgcgactctaagggcgttatttacaaaggccgtgagccgaatatggcggagaccaaagcggcctatgcggtagacgacagcggcaagcgcacgctggatgaggtcattgacggcgcggatattttcctcggctgttcaggcccgaaagtgctgactcaggagatggtgaagaaaatggcccgcgcgccaatgattctggcgctggctaacccggaaccggaaattctgccgccgctggcgaaagaagtgcgtccggacgccatcatctgtaccggtcgttccgactatccgaaccaggtgaacaacgtattgtgcttcccgtttatcttccgcggcgcactggacgtcggcgcgacggcgatcaacgaagagatgaaactggcggcggtccgtgcgattgccgagctggcgcacgccgaacagagcgaagtggtggcctcggcctatggcgatcaggacctgagctttgggccggaatacattattccgaaaccgtttgacccgcgtctgattgtcaaaatcgctccggcggtcgcgaaagcggcaatggattccggcgtggcgacgcgcccgattgctgactttgatgcctatatcgataaactgaccgagtttgtctacaaaactaacctgttcatgaagccgatcttctcgcaggcacgcaaagatccgaagcgcgtagtgctgccggaaggggaagaggcgcgcgtgctgcacgcaacccaggagttgataaccctggggctggcgaagcccatcctgatcgggcgtccgagcgtgatcgaaatgcgtatccagaaactggggttacagatcaaagcgggcgttgatttcgagatcgtgaataatgaatccgatccgcgcttcaaagagtactggagcgagtattaccagatcatgaagcgtcgcggggtaactcaggaacaggcgcagcgtgcgatgatcggcaaccatacggccattggcgcgatcatggtgcagcgtggagaagcggatgcgatgatctgcggcaccatcggcgactaccatgagcatttcagcgtcgtgaaagccgtctttggctaccgtgacggcgtgcatacggcaggggcgatgaacgccttactgctgccaagcggcaacacttttatcgccgatacttatgttaacgaagatcccacgccggaacagttggcggagatcgccgtaatggcggcggaaaccgttcgccgctttggtattgagccgaaagtcgcgctgttgtcgcactctaactttggttcctcaaattcgctgtccgccagcaaaatgcgcgaaacccttgagcgggtacgcgaacgagcgcccgatctgatgattgacggtgagatgcacggtgatgcggcgttggtggaaagtattcgtaatgaccggatgccggatagtccgctgaagggagccgccaatattctggtgatgccgaatatggaagccgcccgcattagttacaacttactccgcgtctccagttccgaaggcgtcacggtcggcccggtcctgatgggcgtgtctaaaccggtacatgtattaacgccgatcgcctctgtacgccgtatcgtgaatatggtggcgttagcggtagttgaagcgcaaaccacgccgctttaataacgcattactctctcttctggcgcaggttctcctgcgcttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtccaatgagggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatatttacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattttatgcgccgctgggcttcgccatggtatgaaaggctcgggtggggatattctggaacctattgcgttacccctacttatttcactgaatctgtactatgcacaaatcgagtgatacgcattatttttatcaataatagtaatacaaagaatagccggtgggtatttattgcggaacaagcttaaattcagaatgacgcctgaaaatgtgatgcaccacgatatttatcgttaacaccttcgacagaagtcccttttattttctttctcttagtgatctacctcaccttttacatcaccttgccgaattttgttatttactccgacaaaaaattgccacgatgacggcagtttcagtggagacggtgagcaatgaataaagaacgcattattcaggaatttgtgccgggcaaacaggtcacgctggcgcatctcattgcgcaccctggtgaagaactggcgaaaaagatcggcgttcccgatgctggcgcgattggcattatgaccttaacgccgggggaaacggccatgatcgctggcgatttagcgatgaaggctgcggatgtacacatcggttttctcgacagatttagcggcgcgctggtgatttatggcaccgtcggcgcagtagaagaagcgctattacagacggtcagcgggctggggcgattattaaacttcaccctgtgtgagttaacaaaaagttaattggtggcggtaatgaaacgtattgcttttgtcggcgcggtcggcgccggaaagacaacgctttttaacgcgttacggggaaattattccctcgccagaaaaacgcaggccgtggaatttaatgatcatggcgatatcgatacgccgggtgaatattttagccatccccgttggtatcacgccttaattaccacgttgcaggatgtggacacgctgatttatgtccacgcggcaaacgataaagaaagtcgcttacctgccgggttattggatgttggaacccgtaaacgacatatcgccgttatcagcaaaacggacatgccggatgccgacgtcgccgctacgcggcagttgctttgcgagattggattccgggagccgattttcgagctcaacggccacgacccgcaaagcgtgcggcagttggtggattatctggcggctctcagtgaacaggaggaagaggcaggtgaaaaaacttatcacagctaacgatattcgtgcggcccacgcccgcggcgaacaggcgatgtcggtagtgctgcgcgccagcattattaccccggaggctcgcgaagtggcggaactactgggcttcacgattaccgaatgcgacgagtccgtcccggcatccacatcggcgcaggcgtgtaaaagcgaaagccagcgcattcgggaagccatcatcgcgcagcgcccggaagggcagtttactgaaagcctggtggcgcagttgatggaaaaagtgctcaaggaaaagcagtcgctggaactggggacgatgcagccgagctttacctccgtcacgggtaaaggcggcgtgaaagtcattgacggcagcagcgtgaaatttggccgcttcgacggcgccgaaccgcactgcgtcggcttaaccgatctggttacagagcaggatggcagcagcatggccgccgggtttatgcagtgggacaacgcctttttcccgtggacgctgaactacgacgaaatcgacatggtgctggagggtgaactgcacgtacgccatgaaggcgaaaccatgattgccaaagccggagatgtcatgttcatccctaaaggctccagcattgaatttggcacgccaacgtccgtgcgctttctgtacgtcgcctggcctgcaaactggcaatccgtatgaacgatttcatcaccgaaacgtggctcagagcgaatcatacgctcagcgaaggatcggaaatccatctgcccgctgacgcacgactgacgccctcggcccgggaactgctggaaagtcgtcgcctgcgcattaagtttctggatcagcaaggccggctgtttgtcgatgatgacgaacagcagccggtacatggcttaaccagtagcgatacgcacccacaggcctgctgtgaactgtgccgccagccggtggtgaaaaagcccgatacgctgacccatctgacggcggacaaaatggtcgccaaaagcgacccgcgcctcggctttcgcgccgcgctcgacagcgccatcgcgctgaccgtgtggctacaaatcgaactggcggaaccctggcagccgtggcttttcgatatccgctcgcggctgggcaacattatgcgcgccgacgctatagatgaaccgctggcggcgcagtctatcgtcgggctgaacgaggatgagctgcatcggctttcccaccagccgctgcgctatctcgaccacgatcacctggtgccggaggccagccacggtcgcgatgcggcgctgcttaatctgctgcgaaccaaagtccgcgaaacggaaaccctcgccgcacaagtgtttattacccgtagttttgaggtcttgcgcccggacattttacaggcgctaaaccgtctctccagcacggtttacgtgatgatgattttgagcgtggcgaaacatccgctgacggtcgcccaaattcaacaacggttgggagagaagccatgatcattgaacgcgcccgcgaactggcggtacgcgcccccgccagagtcgtctttcccgatgcgctggacgaacgcgtgctgaaagcggcgcattacctgcaacagtgcggtctggctcgccccgttctggtcgccagtccgtttgcgctgcgtcagtttgccctgagtcatcgtatggcgatggatggcattcaggtcatcgacccacacagcaacctgagtatgcgccagcgttttgcgcaacgctggcttgcccgtgccggagaaaaaacgccgccggacgcagtggaaaagcttagcgacccgctaatgttcgctgccgccatggtgagcgccggtgaggctgatgtgtgtatcgcaggcaacctgtcgtcaacggcgaacgtgctgcgcgcagggctgcgggtgattggcctgcaacccgggtgcaaaacattatcgtctattttcctgatgctgccgcagtatgccggcccggcattagggttcgccgattgcagcgtagtgccgcagccgacggcggcgcagctggcggatatcgctatcgccagcgccgacacctggcgggccattaccggcgaagagccgcgcgtggcgatgctgtcattttcaagcaacggcagcgcccgtcaccccaatgttgccaacgtgcagcaggcgacagagttcgttcgcgaacgtgcgccgcaactgcttgtggacggtgaattgcagtttgacgccgctttcgtaccggaggtcgccgcgcaaaaagcgcctgacagcccgctgcaaggccgcgccaacgtgatgattttcccgtcgctggaggcgggcaatattggctacaaaatcgctcagcgtctgggaggctatcgcgctgttgggccgctaattcaggggcttgccgcgccgcttcacgacctctcccgaggctgtagcgtgcaggaaattatcgaactggcgttggtggcagccgtgccgcgccaggctgacgtgagccgcgaacgcagcttacacacactggttgaatgaacggtcccgttctggacccctttaatgagaggaaaacacgatggaagcattaggaatgattgaaacccggggcctagttgcgctgattgaggcctcagatgcgatggtaaaagccgcacgcgtgaagctggtcggtgtgaagcagattggcggtggcctgtgtacggccatggtgcgtggcgacgtggcggcgtgcaaagccgcaaccgatgctggcgccgctgcggcgcagcgcattggcgagctggtctctgtacacgtgattccacgcccgcacggcgatctggaagaagtgttcccgatcagcttcaaaggcgcagcaacatttgatggtaggccggataagacgcgcagcggcgccatccggcatgaatgcgcgccattgcctgatagtgcgcagattcaaggcctacgacccaacgggcaatccatggaggcggatatgaaactggcagtcgtcacaggacaaatcgtatgtaccgtccgccatcagggactggcgcatgacaaattgctgatggtggaaatgatcgatgcccagggcaaccccgacgggcagtgtgccgtcgctatcgacagtatcggggcgggaaccggagagtgggtactgctggtcagcggcagttccgcgcgccaggcgcatcgcagcgaattatcaccggtcgatctgtgcgtcattggcatcgtcgatgaagtggtggctggcgggaaagtggttttccataaataggactgaacatcatgaatcaacaggatattgaacaggtggtgaaagcggtgctgctgaaaatgaaagacagcagccagccggccagcactgttcatgagatgggcgtttttgcctccctggatgacgaagtggcggcagcaaaacgggcccagcaggggctgaagagcgtggcgatgcgccagcttgccattcatgccattcgcgaggcgggcgaaaaacacgcccgagaattagcggaacttgccgtcagcgaaaccggcatgggacgcgttgacgataaatttgccaaaaacgtggcgcaggcgcgcggcacgccgggcgtcgagtgtttatctccgcaggtgctgaccggcgataacggcctgacattgattgaaaatgcgccgtggggcgtggtggcctcggtcacgccgtccaccaatccggcggcgacggtgatcaataacgccatcagcctgattgccgcaggcaacagcgtcgtgtttgccccgcatccggcggcgaaaaaggtctctcagcgggcaatcaccctcctcaatcaggcggtggtcgccgccggcggcccggaaaatctgctggtcaccgtggcgaacccggatatcgaaaccgcccagcggctgttcaagtaccccggtattggcctgctggtggtgaccggcggcgaagcggtggtggacgcggcgcgcaaacatactaataaacgcctgatcgccgccggtgccggcaatcccccggtggtggtggatgagaccgccgacctgccgcgcgccgcacaatccatcgtcaaaggcgcgtcgtttgataacaacatcatctgtgccgacgaaaaagtgctgattgtggtggatagcgtcgccgacgagctgatgcgtctgatggaaggtcagcacgcggtgaaactgactgccgctcaggccgaacagctccagccggtgctgctgaagaatattgatgagcgcggcaaaggcaccgtcagccgtgactgggtcggtcgtgacgcgggcaaaatcgccgcagccattggcctgaacgtcccggatcaaacgcgcctgctatttgtggaaacgccagctaaccatccgtttgccgtcactgaaatgatgatgccggtactgccggtggtgcgggtcgccaacgtcgaagatgccatcgccctggcggtacaacttgaaggcggttgccaccatacggcggcgatgcactcgcgcaatatcgacaacatgaaccagatggcgaacgccatcgacaccagcattttcgtcaaaaacgggccgtgcattgccgggcttggattgggcggagaaggctggaccaccatgactatcactacgccaaccggcgaaggggtgaccagcgcgcgtacctttgtgcggctgcgtcgatgcgtgctggtggatgcgtttcgcattgtataagggatgactcatggcgcacgacgaacaactctggctcaccccaagactgcaaaaagcggcggccctgtgtaaccagacgcccgccgccagcgacacaccgctgtggctgggcgtcgatttgggcacctgcgacgtggtgtcgatggtggtcgacggcaacgcccagccggtggcggtgtgccttgactgggccgacgttgtgcgtgacggcatcgtctgggatttcttcggcgccgtcaccctcgtgcgccgccatctcgacacccttgaacagcagctcggctgccgctttacccacgcggcgacctcgttcccaccgggcaccgacccgcgtatttcgatcaacgtgctggagtctgctgggttagaagtcagccacgtactggatgaaccgacggcggtggcggatctgctggcgcttgataatgcaggcgtggtggatattggcggcggcactaccggcattgccatcgtcaaacagggcaaggtgacttactccgccgatgaagccactggcgggcaccatatctccctgacgctggcgggcaaccgccgtattcccctagaagaggcggaacagtacaagcgcagcaatgcgcaggagatttggccggtagtgaagccggtgtacgaaaagatggcggagatcgttgctcgccacattgaagggcaaggaattgctgatttatggctggcgggcggttcctgtatgcagccgggcgtggaggcgttatttcgccagcgtttcccggagttacaggtgcatttaccgcagcacagcctgtttatgaccccgctggcgatagctaacagcgggagagcgaaagcggagggactctatgcaagctgaactacagacggcgctgtttcaggcattcaacaccctgaatctgcaacgggtgaaaacgttcagcgtaccgccggtcacgctgtgcgggcttggggcgctcggcgcctgcgggcaggaagcgcaagcgcggggcgtaagccatttgtttgtgatggtcgacagcttcctgcatcaggcgggaatgaccgcgccgctggcacgcagcctggcgatgaaaggcgtggcgatgacggtctggccgtgtccgccaggcgagccgtgcatcaccgatgtctgcgcggcggtggcgcaactgcgtgaggcggcgtgcgacggcgtagtggcctttggcggcggttcggtgttggacgcggcgaaagcggtcgccctgctggtgactaaccctgaccagacgctgagcgccatgaccgagcgcagtacattacgcccgcgtctgccgctgattgcggtgccgaccaccgccggaaccggttcagaaaccaccaacgtgacggtgattatcgacgcggtcagcgggcgcaagcaggtgctggcacacgcgtcactaatgccggatgtggcgattcttgatgctgccgtgaccgaaggcgttccgccaaatgtgacggcgatgaccggtatcgatgcgctgacgcatgcgattgaggcctacagcgcgctcaacgccacgccgtttaccgacagcctggcgattggcgcgatagcgatgattggcaaatcgctgccgaaggccgtcggctatgggcaggatctggcggcgcgtgaaaatatgttgctggcctcctgtatggcgggaatggccttttccagcgccggtctggggctgtgtcatgcgatggcgcaccagccaggggcggcgctgcatattccgcacggccaggccaacgccatgctgctgccgacagtcatgggctttaaccggatggtatgccgcgagcgcttcagtcaaatcggtcgggcgttaaccaataagaaatcggacgatcgcgatgcgattgcggcggtgtgcgagctgattgccgaagtggggcagagcaaacggctggctgacgctggcgccaaacccgaacactacagcgcgtgggcgcaagccgcgctggaggatatttgtctgcgcagtaacccacgcaccgccacacaggcacagattatcgacctgtacgcggctgccgggtaatgctgtaggccggataaggtgctcgcatcgccatccggcaataacacggcgttaatgccggaggcgacgtaaacgtcttatccggcttacaaatcaaaaatgacagggagtaggggctatgggaattaacgaaatcatcatgtacatcatgatgttctttatgctgattgccgccgtggacaggatcctgtcgcagttcggcgggtcggcgcgcttcctcggtaaatttggcaagagtatcgaggagtctggcggccagtttgaagagggctttatggcgatgggcgcgttgggactggcgatggttggtatgaccgcgctggcgccggtgctggcgcatgtactggggccggttattatcccggtatacgaaatgctgggcgcgaacccatccatgttcgcgggtacgctactggcttgtgatatgggcggattcttcctcgccaaagagctggccggcggtgatgtcgcggcgtggctatactcagggttaatacttgggtcgatgatggggccgaccattgtgttctccattccggtggcgctcggcattatcgaaccgtctgaccgccgctacctggcgcttggcgtactggcgggtatcgtcaccattcccattggctgcattgcgggggggttgatcgccatgtactcaggtgtgcagatcaatggtcagccagtggagtttaccttcgcgctgatcctgatgaacatgatcccggtattgatcgtcgcggtgctggtagcgctggggctgaagttcatcccggaaaaaatgatcaacggtttccagattttcgccaaatttctggtggcgctgatcaccatcggtctggcggctgcggtggttaaattcctgttgggctgggagttgattccggggctcgacccgatctttatggcgccaggcgacaaacccggcgaagtgatgcgcgccattgaagtgatcggctctatctcctgcgtgctgctcggcgcgtatccgatggtgctgttactgacccgctggtttgaaaaaccgttgatgaatgtcggtaagctgctgaacgtaaataatattgcggcggcaggcatggtagcgaccctggcgaacaatatccccatgttcggcatgatgaagcagatggatacccgcggcaaagtgattaactgcgcatttgccgtctctgcggcgttcgcgctggtcgaccatttaggcttcgccgctgccaacatgaacgccatgatcttcccgatgattgtcggcaagctgatcggcggcgtgacggcgattggcgtggcgatgatgctggtgccgaaagatgacgccgcccaggtgaaaaccgaagcggaggcgcaatcgtgaacactcgccagctactgagcgtcggtatcgatatcggcaccaccaccacgcaggtgatcttctcgcgcctggagttggttaaccgtgcggcggtgtcgcaggtgccgcgctacgaattcatcaaacgcgacattagctggcaaagcccggtcttctttacgcccgtggataagcagggcggtctgaaagaggcagaacttaaagcgctgattctggctcagtatcaggccgcaggcatcgcgcctgaatcggtggactcaggggctatcattatcaccggcgaaagcgccaaaacccgcaacgcccgtccggcggtcatggcgctctcgcagtcgctgggcgactttgtggtcgccagcgccgggccgcatctggaatcggtcattgccggttacggcgccggggcgcaaagcctgtctgagcagcggatgtgccgggtgctgaatattgatatcggcggcggcacgtctaactacgcgctgtttgacgcgggaaaagtcagcggcaccgcctgccttaacgtcggtggtcgcctgctggaaaccgacgctcaggggcgcgtggtttatgcccatcagccggggcagatgattatcgatgaggtgttcggttcgggtactgatgctcgcgccttagctgccgcacagttggggcaggtggcgcggcggatggcggatctcatcgtcgaggttatcactggcgcgctctcgccgctggcgcaatcgctgatgcaaaccgggctgctgcccgccgatattacgccggaggtgatcaccctttccggtggagtaggtgaatgctaccgcaaccaacctgccgatccgttctgcttttctgatatcgggccgctgctggcgaccgcgctgcatgagcacccgcgtctgcgcgagatgaacgtgcagtttccggcgcaaaccgtacgcgccacggtgattggcgcgggggcccatacgctctcgctttccggcagtactatctggctggaagacgtccaactgccgctgcgcaacctgccggtggcgatcccgcaggatgacgccgatttggtgaacgcctggcggcaggcgcttctccagcttgatctcgacccgcaaaccgacgcttacgtgctggcgcttccctccacgcttccggtgcgttacgccgcattactcacggtcatcaacgcgctgacggcttttgtcgcgcgttatcccaatccacatcccctgctggtggtggccgagcaggattttggtaaagcgctgggcatgttattgcgcccacagttaccgcaacttccgctggcggtcatcgatgaggtggtcgtgcgggcgggagactatatcgacattggtacgcctctttttggcggatcggttgtgccggtgacggtgaaatcactcgcatttccttcctgagggaacgacttatgaaactaaagaccacattgttcggcaatgtttatcagtttaaggatgtaaaagaggtactggctaaagccaacgaactgcgttcgggggatgtgctggccggggttgccgcggcaagttcgcaggagcgcgtagcggcaaaacaggtactgtcggaaatgacggtggcggatatccgcaacaatccggtgattgcctatgaagaggactgcgtgacgcgcctgattcaggatgacgtcaacgaaacggcctataatcggattaaaaactggagcatcagcgaactgcgcgaatacgtactgagcgatgaaacctccgtggacgacatcgcgtttacccgcaaaggcctgacctccgaagtggtggcggcagtggcgaaaatctgctccaacgccgacctgatctacggcggtaagaaaatgccggtgatcaaaaaagccaataccaccatcgatattccgggcacctttagctgccgtttgcagccgaacgatacccgtgacgatgtgcagagtatcgccgcgcaaatctacgaagggctttctttcggcgcaggcgatgcggtgatcggcgttaacccggtgaccgatgacgtggagaacctgacccgcgtgctcgacaccgtttacggcgttatcgataaattcaatattccgacccagggctgcgtgctggcgcacgtcaccacccagattgaagcgattcgtcgcggcgcgccaggcggactgattttccagagcatttgcggcagcgagaagggcttaaaagagttcggtgtcgagctggcaatgctcgacgaagcgcgggcagtgggggcggagttcaaccgcatcgccggggaaaactgcctgtactttgaaaccggacagggctcggcgctgtcggctggtgcgaactttggtgccgaccaggtgacgatggaagcgcgtaactacgggctggctcgctactacgatccgttcctggtgaacaccgtggtgggctttatcgggccggagtatctctacaacgacaggcagattatccgcgccggtctcgaagatcactttatgggcaagctgagcggcatctcgatgggctgcgactgctgctataccaaccatgccgacgccgaccagaaccttaacgaaaacctgatgattctgctcgccactgccggctgtaactacatcatggggatgccgctcggcgacgacatcatgctcaactaccagactaccgctttccacgataccgccaccgtccgtcagttgctgaatttacggccgtcgccggagtttgaacgctggctggaaacgatgggcattatggcaaacggtcgtctgaccaaacgggcgggcgatccgtcactgttcttctgatgacgcggggataacaccatggatcaaaaacagattgaagaaattgtacgtagcgtgatggcgtcaatgggacaggacgtaccgcagcccgtcgcgccgtcaacgcaggaaggcgcaaagccgcagtgcgccgcgccgacggtgaccgaaagctgcgcgctggatttaggttccgcagaggcaaaagcctggattggcgtcgagaatccgcatcgtgcggacgtgctgaccgaactgcgtcgcagtactgcggcacgcgtctgtacgggtcgtgccgggccgcgtccgcgcacccaggcgctgttgcgcttcctggcggatcactcccgttcgaaagacaccgtgctcaaagaagtgccggaagagtggggcaaagcgcaagggctgctggaagtacgttcggagatcagcgacaaaaacctgtacctgacgcgcccggatatggggcgtcgcctgagcccggaagccattgacgcgctgaagtcgcagtgcgtgatgaacccggatgtgcaggtagtggtctccgatggcctctctacggatgcgatcaccgccaactatgaagagatcctgccgccgctgcttgccggtctgaagcaggccgggctgaacgtcggcacgccgttctttgtgcgctatggccgcgtgaagattgaagatcagattggcgaaattctcggcgcgaaggtcgtcatcctgctggtgggcgaacgtccggggctggggcagtcggaaagcctctcctgctacgccgtctattccccgcgcgtggcgaccaccgtcgaggccgacagaacctgtatttcaaacattcatcagggggggacgccgccagtagaagctgccgccgtgattgtggatttggccaaacggatgctggagcagaaagcgtccggcatcaacatgacccgttaaggagacatcatgcctgcattagatttgattcgaccttcagtgactgccatgcgcgtgattgcctccgtgaatgacggctttgcgcgggaacttaaattaccgccacatatacgtagtctcggactcatcacggcagattctgatgatgtgacctatattgccgctgacgaagcgaccaaacaggcgatggtggaagtagtctatggccgctccctctatgccggggcggctcacgggccgtcgcctaccgccggtgaagtgttgattatgctgggcggaccgaacccggcggaagtgcgcgccggtctggatgcgatggtcgccagtattgaaaacggcgcggcgttccagtgggcgaacgatgcggaaaataccgcgttcctggcgcatgtggtttcgcgtaccggctcgtacctctcgtctaccgcaggtatcgcgctgggcgatccaatggcctacctggtggcgccgccgctggaagcgacattcggcattgacgcggcgatgaaatccgctgacgttcaactggtgacttacgtgccgccgccgtcggaaaccaactattcggccgcgtttttaacgggaagccaggccgcgtgtaaagccgcctgcaacgcctttaccgacgccgtgctggatatcgcccgtaaccctgtccagcgtgcgtaacggaggctgccaatgatcaatgccctgggattactggaagtggacggaatggtcgccgccgtcgatgcggcggatgccatgctgaaagcggccaacgtgcgtttgctcagtcaccaagtgctcgaccctggcaggctcacgctggtggtggagggcgatctggcggcgtgtcgtgcggcgctagatgccggaagcgccgccgcgcagcacacaggccgtgtgattagtcgcaaagaaattggtcgtccggaagaggacacccagtggctgattggcgggtttgcgcgtgcgacaacgccgactgagaaagcgccccaggtacccgcaacgcctgagttcgctgaagcgttactggcgctgctggcatcagtacgccagggaatgacggcgggagaggtggccgcgcattttggctggccgctggagcaggccagaaacgtgctggaacaactcttttctgacggagcgttgcgtaaacgcagtagtcgctatcgcatcaaaaattaatctgtcggagggccgggcgtcctggcgggcgtccggcatagaagatcatgaaaaaaacccgtacagcgaatttgcaccatctttatcatgaagcgttacccgaagacgttaaacttacgcccagagtcgaggtggacaatgttcatcagcgacggacgacggatgtctatgaacatgctctgactatcaccgcctggcagcagatctacgatcagttacacctgggtaaatttcatggcgagttcacggaaatcctgcttgatgagattcaggtgttccgtgaatacaccggcctggcgctgcgtcagtcgtgtctggtttggccaaactctttctggtttggtattccggcgacgcgcggcgaacagggatttattggcgcgcaggggctcggcagcgccgagattgccacccgaccgggaggcaccgagtttgaactgagcacgccggatgattacaccattctgggcgtcgttatctcggaagatgttatttcccgtcaggccacgtttttgcataacccggaaagggtgctgcatatgctgcgtaaccagttagcgctggaggtaaaagagcagcataaagcggcgctgtggggctttgtgcagcaggcgctggccacctttagcgagagtcctgaaaccctgcatcaacctgcggtgcgtaaggtcttgagtgataatttgttgctggcgatgggcacgatgctggaagaggcgaagccgattcatagcgccgaaagcatcagccatcagggatatcgtaggctactgtcgcgggcgcgggaatatgtgctggaaaatatgtcggagccgctgacggtgctcgacttatgtaaccagctacacgtaagccgtcgcacgctgcaaaatgcgtttcacgccattttgggcattggccccaatgcgtggctgaaacgtattcgcctcaatgcagtgcgccgggagttgattagcccgtggtcgcagagcaccacggtcagagatgccgcgatgcagtggggattctggcatctggggcagtttgccaccgattatcagcaattatttgccgaaaaaccgtcgttgacgctgcatcaacggatgcggcaatgggcttgatattgatgggtaggctctccggttgctgataacgtgcgcgtgtcgggaattgcccggtggcggctggcgccttaccgggcctacggattcgctgctgtttgtggttggtagcccggacaaggcgcgccagcgccgcctccggggaagcgcgcgcacaacgtgcaaaacagttttgtcatcagatcatgaggatgagcgtttatgtttgctgataagacgttgccgttgtttggcaggaggggcagataaacccgtaaagcattccttccgcatattcctcttcctcgatatcttcatagcttagctgcgcaagaaacatcatcgtttgcgcgcacgttgggcacgtgggatagtctgtatcctgaacccatgcgggatggccgccgagctgtgagaaggtggtgggtaaaaatatttcagcagcgaatagcggcaaacgggattccccggggtgcagaacatcaagcggtagcgttatccagtcagaggaattctccaccgccagcgtcgagagcgcatttttttcgtaccatcgcggctggccttgtggatcgacggtggcgaaaacggtgttatatgccgtacaacactgacaggtcagaatacgaatttgaccgggccaaccctgcgtgcttaggccgacggcgctcggcgcaacctcaaacagattgattagcggcagggaacagtgtgggcagttttcaccatattctgcaacggcgcgaaaaacggccggctgttcaggtgcctgttttaccagatgggtacattgcgtaaagtaaagatcgcgcctgcggccattttcagtgagctcccatcccgcctggtgagcatagcgatgagggaggatatgaagtgaagcactccacgcaggtggttcctggcgccagcggttaaaatgctcaacgacaacctcatcgccaatccaggccagggcgcaaagaatgccatcacggttttcgtcatcggtttcaaccttctgcaaaagcgcgtcgcgtacgtcaggcggcgcacggtgaaaaggtaggggtgaagagagctccagttcctcttcatttattacttggcgcaggaaattatccagattggcctgggtaaatgccgccaggcacagcgcaatttcctgagcttcctcctgccatccggaatcaaataattcttctgcataatcgaccatgtcgcggctttcatcatcggagagctttttgtaaagctcatcggtcggaatggggcagggaatccactcgattaacggatcgtgttcccggggttcatgaacgagtttaagcatttcaacagggttggtaatgccactgaacgcgtcgatcgtttttctgtttttccggatatattcttcctgctcttgccgatagcgcgcctggacgcagggcatgcaatagccctccgtgcgggcagccgttgctggcaggatgaaatgtgagcattgcgggtttttacaaggaatacgctcgtccatgcggtagtgctccactgcaaattctacgagtgtttactgtactgttttactaatgataacggcagcgggcggttatccgaattctttatctacaatgaactcgtttatttctacgagcctgcttttattcaacggccaaccggataggcgataaacaaaccggctatcgtcaaaatacatgccagtaggcatagcaagatgcagttaacgcttttacgcggaatatgaataataaagcagagtaatgctatcagggccatgaccacagggatggtcaccatattgataaccagaagcacgatcagaccgaagctcacccctccgctatgagggatgaatattctttcttcaaaatatatttctagcgtaatggcaagcaggcagccaataaaacttatacccagatggggatgccatttggcgtcactggttactactttccgtgtatttgtttgcattgttttactttataaataagttaaatccagtcgcgtacctgaataaactcgctcagcgccgcttccgggctacccgcttccggctgccagtcgtactcccagcgcaccagcggcggcatcgacatcaggatagattcagtgcgcccgccggtttgcagaccaaacagggtgcctctgtcccataccagattgaactccacgtagcgaccgcggcgataaagttgaaaattacgctcccgctctccccagaccatcgctttgcgtcgttcgacaatcggtaaatacgcctcggtgtagccgttaccgaccgcctgcataaaagcaaaacagtggtcgaaatccggcgtattcaaatcgtcaaaaaacaggccgccgataccgcgctgctcgttacgatgcttgaggaaaaagtagtcatcgcaccactttttatagcgcggatacacatcgtcgccaaacggctggcacaggtcgcgggcggtgcggtgccagtgaacggcatcctcttcaaagccgtagtagggcgttaaatcgaacccgccgccaaaccaccacaccggatcggcgcccggtttttcggcaataaaaaagcgcacgttagcatggctggtgggaatatacggattgtgcggatgcaccaccagcgatacgcccatcgcttcaaaactacgcccggccagttctggccgatgtgcggtggcggacgcgggcattgcatcgccgtgaacgtgagagaaattaacgcccgcctgttcgaaaattccgccgttgcgtaatacccggctgcgtccgccgccgcccgcttcgcgtcgccagctatcttcgataaagtttgcgccatccacagcggataacgtttggcaaatatcatcctgcaggcgtagcagaaactgttttacgtgatgtgcatcgggtttcatgattaccgtttcttcgtgtgtgctttctgattatcaaaccagtgaaaataactgatgatgccgttggcgatcgccgtagcgattttctggcgaaacgccgtcgtgcccagcaggcgttcttcttccggattggtaataaacgaggtttcgaccagtaccgacggaattgacggtgattttagcaccacgaaagccgcttgttcggtagtgcggctgtgtaatttatgtatgggtttgattttcttgagaatatgcgaacccagcgtcagactgtttttaatcgtatcggtttgcaccagatcaaacaaaacttgttgtaatagatgatcccggtcagtggcttttttacccgccacttcgtccgcgcggttttcacgctcggagagatacttcgccatggcgctactggccccgcggttggaaagcgcaaaaacggaagcgcccgccgctttcggattggtaaaaccatcggcatgaatagacataaacagatccgcgccgtgcttatgggcgatttccactcgatcgtacagcggaataaaggtatcccctgtccgggttaaacgcgcatcgattccgtgatttcgcaaaatagcgcgtacgtttttggcaattgccagtacgacgtgtttttcctgagaaccgttgcggccaatcgcgccggtatcgatgccgccgtgtccggggtcgagcatcaccaaccgtttactgccggtttttttggttttgggtttgctgtgaccattactggtttttagcgtttcttctttggctattgcgtgcgacatacctgacagcgtcagggccgccagacctgttttgagtacctggcggcgcgatgtgagagtttttaggagtttaaaagtgctcatacggcctgagttgtgaaaattaagttcaagatgttatatcgtatcgcgtaatccgttacgacggttggtgatgagaattgttttacttttcatttcaatacgtgacacatcgccattatgccattttttccgctacatcgcgtcagatattggctgaatcagatgtttgcgccataatcttggtttttccacccgaaaaggcaacgaataccatggaaatacgcgtttttcgccaggaagatttcgaagaggtgattaccctctgggagcgttgcgacctgctgcgtccatggaacgatcctgaaatggatattgaacgcaaggtgaatcacgatgtcagcttgttcctcgttgcggaagttagcggcgaagtcgtcggtacggtaatgggcggttatgacgggcatcgcggctcggcgtattacctgggcgttcacccggagttccgcgggcgcggcattgcgaatgcgctgcttaaccggctggaaaaaaaactcatcgcccgcgggtgtccgaaaatccaaattatggtgcgtgatgataacgacgttgtgctgggcatgtatgaacgtctggggtatgagcattctgacgccctaagtttgggtaaacgcctgattgaagatgaagagtactgagtttcatccagccgattatgatgtacacggatgtttacgcctgccgtttctgttctggtgcgtactgctacttcaggcgcgcgcctgggtactctttgtcattgccggttcatcccgtggacagggtaatactttgttaaactttttttatcccgaccatgataatttttggctggggctgttgcccggcgttccggcggtagtggcgtttttactcagcgggcggcgtgaagcggttcctggtgtgtggcgctggctgcgcggactcctgatcctcgctcaactggtgtcgttgtgctggctgccggtgatgtggctgggtggcgacccggtcaacggcgtcgggctggcgctgctgctggcggacatcgtcgcgctgatctggctgttaaccaatcaacgtttgcgtgcctgtttttcccttgagaaagaataacggcactttttggcgaacccgtactccaaccaacgttaattaataaaagaaaggaagtgagatgaaatcgctgcgtttgactttactcgcactgccgctggcgctgaccggctgctcgacgctctcctcggtcaactggtctgccgcaaatccatggaactggtttggttcctcgacagaagtcactgagcaaggcgtgggagcgctgaccgccgccacgccgctggaagagccggctattgcagaggcattagatggcgattatcgcctgcgtagcggtatgaaaaccgataacggcaacgtggtgcgctttttcgaagcgatgaagggcgacagcgtcgcgatggtgatcaacggcgagcagggaaccgtgagccgtattgatgtgctggacagcgatatcccaaccgccgcggggggcaaaatcggtacgccgtttagcgacctttacagcaaagcgtttggtcactgcgagccggtttccagcgatagccataccagcgtcgaatgtaaagccgagggaagtcagcatattagctatgttttctccggcgagtggagcggaccggaaggcttaatgcctcctgatgacgtcttaaaaaactgggacgtgcgcaaaattatctggcgtcgttaatttgcgcctgaacaaaccgcttcgcttaaaaacaaggtaaaataacctccattaatgccacgactgcgtggcattctcattttcaggaggaatcatgtctcaggttcaaagtggcattttgccggaacattgccgtgcggcaatttggattgaagccaatgtaaaaggcgacctggacgccctgcgcgcggccagcagaacatttgccgataaactggcgaccttcgaagtcaaatttccggacgcccatcttggggccgttgtggcgtttggcaacaatacctggcgtgccctgagtggcggcgtcggggcggaagaactgaaagattttattccttatggtaaagggctggcgccagccacgcagtatgacatgctgatccatatcctttccctgcgccacgatgtgaatttttctgttgctcaggcggcgatggaagccttcggcgactgtatcgacgtgaaagaagaagttcacggcttccgttgggtggaagaacgcgatctgagcggctttgtcgacgggacagagaacccggcgggcgaagagacgcgtcgtgaagtggcggtgatcaaagatggcgtggatgccggcggcagttatgtgttcgtgcagcgttgggaacacaatctcaagcaacttaaccggatgagtattcacgatcaggagatgatgatcgggcgtaccaaagaagccaatgaagagattgacggcgatgcgcgtccggcaacatctcacctgagccgcgtcgatctcaaagaagatggcaaagggctgaagattgtgcgtcagagcctgccatacggcaccgccagcggtactcatggtctctatttctgcgcttactgcgcacgcctgcacaatatcgaacagcagcttctgagtatgttcggcgataccgacggtaaacgcgacgcaatgctgcgcttcaccaaaccggtgactggcggctactattttgcgccgtcgctggatcgcctgttagcgctataagtaaaaccctgtcggatggcagcgcaaacgctttattcgacctacgattggtaggcctgacaagcgccgcgccatcaggcagaacagcataaaaatgcccatccccgcctccgcggggatttttttacctaatatttacctgaattagtgagctattcctcagcacttatttgttattactgtattttcagtgttaatggagtgtaagactccatattcaaaaggagacattgaaaatgggtaaactcacgggcaagacagcattgattacgggcgcatcgcagggcattggcgaagggatcgctcgcgtattcgcacgccacggcgcgaacttaatcttgctggatatctccgatgagattgaaaagctggcggatgagctgggcgggcgcgggcatcgctgtactgccgttaaagccgacgtcagagattttgcttcggtgcaggcggcggttgcgcgcgccaaagagactgaaggtagaattgatattttggtgaataacgctggcgtgtgccgtctgggcaacttcctcgatatgagtgaagaagatcgcgatttccacattgatattaatattaaaggtgtctggaacgtcaccaaagccgtcctgccggagatgatcaaacgtaaagatggccgcattgtgatgatgtcttccgtcacgggagatatggtggcggacccgggtgaaacggcctatgcgctgtcaaaagccgccattgtcggtttaaccaaatcgctggcggtagagtacgcgcagtccggtattcgtgtgaatgccatttgccccggttatgtaagaacgccgatggcggaaagcattgcccgtcagtctaaccctgacgatccggaatcggtattaacggaaatggcaaaagccattccgctacgccgtcttgccgatccgctggaagtaggggaactggcggcatttctggcttccgatgagtccagctatcttaccggaacgcaaaacgtcattgatggcggcagtaccctgcctgaaagcgtaagcgtaggcgtctgattgatgccggtctcctcctcacgccgcgtggggagggattctcttattcccttttcaactttcaaatcatcaaacggtatataaaaccgttactcctttagcgctggttataaatatgatgaccataagaaagtcattaaatttataagggtgcgcaatggccgttaacttactgaaaaagagactcctgacgctggcagcaatgctgttactggcagggcaggcgcaggcaacggagctgctgaacagctcatacgatgtctcccgcgagctgtttgccgcccttaacccgccgtttgagcaacaatgggcgaaggataacggcggcgataagctgacgattaagcagtctcatgccgggtcatcaaaacaggcgctggcgattttgcagggactgaaggcagacgtcgtgacctacaatcaggtgaccgacgtacagattcttcatgataaaggcaaactgatccctgccgactggcaaagccgtctgccgaacaacagttcgccattctattccactatgggcttcctagtgcgcaaggggaacccgaaaaatattcacgactggagcgatcttgtacgtttcgacgtgaagctgattttccctaacccgaaaacctccggcaacgcccgttacacgtatctggcggcatggggcgcggcggataacgcggacggcggcgataaagccaaaaccgaacagtttatgacccagttcctgaaaaacgtcgaagtgtttgataccggcggtcgcggcgctacgactacctttgccgagcgtggtctgggcgatgtgctgattagttttgaatcggaagtgaacaacatccgcaaacaatatgaagcccagggatttgaagtggtgatcccgaaaacgaacattcttgctgaattcccggttgcctgggtggataaatacgtgaaggccaacggcacagaaaaagccgccaaagcttacctgaactggctgtatagcccgcaggcgcagaccatcattacccattactactaccgcgtgaataacccggaaatcatgggcaagcaagcagataaattcccgcaaaccggactgttccgcgtggaagacaagtttggcacgtggcctgaggtgatgaaaacgcactttgccagcggcggcgagctggacaaactgttggcggcggggcgtaagtaatgcttgccgtttcttcccgacgcgtgctgcccggctttacgttaagcctcggcaccagtttgctgtttgtctgcctgatcctgctgttgccgttgagtgcgctggtgatgcagctctcacagatgagctggtcgcaatactgggatgtcgtgaccaacccacaggtggtggctgcttataaagtgacgctgctggcggcatttgtggcgtcgatttttaatggcgtgtttggcctgctgatggcgtggattttaacccgctaccgttttccagggcgcacgttactggatgcgctgatggatctgccatttgcgctgccgacagcggtggcggggttaacgctggcctcgctgttctcagtgaacggtttctacggtcagtttcttgcgcagtttgatatcaaagtgacctatacctggctcggtattgcggtggcgatggcctttaccagcattccatttgtggtgcgcaccgtccagccggtactggaagagctggggccggaatatgaagaagcggcacaaacgctgggggccacccgcctgcaaagttttcgcaaagtcgtgctgcctgagctgtcgcctgcgctgattgccggcgtggcgctctcttttacccgtagcctgggcgagtttggcgcggtgatttttatcgccggaaatatcgcctggaaaacagaagtgacctcgctgatgatttttgtgcgtttgcaggagtttgattacccagctgccagcgccattgcctcggtgatccttgcggcatcactgctgctgctgttctcaattaacactctgcaaagtcgctttggtcgacgtgtggtaggtcattaatggcggaagtgactcaattgaagcgatacgacgtcccccgtattaactggggaaaatggtttttgattggcgtcgggatgctcgtttcggcctttatcctgctggtgccgatgatttacatcttcgtgcaggcgttcagcaaagggttaatgccggtactgcaaaatctggccgatccggacatgctgcacgccatctggctgacggtgttgattgccttgatcgcagtgccgatgaatctggtgttcggtattctgctggcgtggctggtgacgcgctttaacttccccggacgtcagctactgctgaccctgctggatattccctttgccgtctcaccggtggtggccggtctggtttatctgttgttttatggttccaacggcccgttgggcggctggctggatgagcataatttgcaaatgatgttctcctggccggggatggtactggtcactatttttgtcacctgcccgtttgtggtgcgcgaactggtgccagtgatgctcagccagggcagccaggaagatgaggcggcgattttactgggcgcatccggctggcaaatgtttcgccgcgtgacgttgccgaatattcgctgggcgctactctacggcgtggtattaaccaacgcccgcgcgattggcgagtttggcgcggtgtcggtggtgtccggctcgattcgcggcgaaacgttatcgctaccgttacagattgaattactggagcaggactacaacaccgtcggctcctttaccgccgccgcattgttgacgctaatggcgattattaccctgtttttgaagagcatgttgcaatggcgtctggagaatcaggaaaaacgcgcgcaacaggaggaaaatcatgagcattgagatcgccagaattaagaaatcgtttggtcgcactcaggtactgaatgatatctcgctggatattccttccggccagatggttgccttgttggggccgtctggttccggcaaaacgacgctgctgcgcattattgccgggctggaacatcagtccagcggccatattcgtttccacggtacggacgttagccgcctgcacgcgcgtgagcgtaaagtcggttttgtgtttcagcactatgcgctgtttcgccatatgacggtgtttgacaacatcgcttttggcctgacggtgctgccgcgacgcgaccgcccaactgcggcggctattaaaacgaaagtgacgcaattgctggagatggtgcaactggcgcacctcgcggatcgcttccccgcccagctttccggcggacaaaaacagcgcgtggcgctggcgcgcgcgcttgccgtagaaccgcaaattctactgctggatgaaccgtttggcgcgctggatgcccaggtacgtaaagagttacgtcgctggttgcgccagctacatgaagaactgaaattcaccagcgtctttgtcacccacgatcaggaagaagcgacggaagtggcggatcgggtggtggtaatgagtcagggcaatatcgaacaggctgacgcgccggatcgggtgtggcgtgaaccggcaacccgcttcgtactggagtttatgggcgaggtgaaccgcctgacaggcaccgtccgcggcgggcagtttcacgttggcgcgcatcgctggccgctgggttatacgcccgcgtaccaagggccggtcgatctgttcctgcgtccgtgggaggtggatatcagccgccgcaccagcctggattctccgctaccagtacaggtcattgaggcaagcccgaaaggtcactatacacagttagtggtacagccgctggggtggtatcacgatccgctgacggtggtgatggcgggtgacgacgtcccgcagcgcggcgagcgtttgtttgtcggcttacagaacgcacgtctctatcatggcgaccagcgtattgagccccatgaggcgcttgctcttgcggagtctgcctgataggttaatttgcatagttatcgcccggtggcgcttcgcttaccgggcctacagcgtatatcgtgattttgtaggccgggtaagcacagcgccacccggcatttttattgagctgaaaacgtgaatacattagaacaaaccatcggcaatacgccgctggtcaaattacaacggctggggccggataacggcagtgaaatctgggtcaagctggaaggcaataatccggcaggatcggtgaaagatcgcgcggcgctatcgatgattgtcgaggcggaaaagcgcggggaaattaaaccgggcgatgccctgattgaagcgaccagcggcaacactggcattgcgctggcgatgatcgccgcgctgaaaggttatcgcatgaagctgttgatgccggacaacatgagccaggagcgtcgggcggcaatgcgggcctatggcgcggaactgattctggtcactaaagagcagggaatggaaggggcgcgcgatttagcgctcgctatgtctgagcgcggagaaggtaaactgctcgatcagtttaataatcctgataatccctacgcccactacacgaccaccggcccggaaatctggcggcaaacgtcaggtcgcatcacccattttgtctccagcatgggcacgaccggcaccattaccggcgtgtcgcgttttctgcgcgagcaggaaaaaacggtcaccatcgttggcctgcaaccggaagagggcagcagtattccgggcattcgccgctggcctacggaatatatgccgggcatatttaacgcctcgctggtggatgaggtgctggatattcatcagaatgatgccgaaaacaccatgcgtgaactggcggttcgtgaagggattttctgcggcgtcagctccggcggcgcggtagcgggcgcgttacgcgtcgcacgagccacgcccggcgcgatagtggtggcgatcatctgcgatcgcggcgaccgttacttgtctaccggcgtgtttggtgaagagcatttcagccagggggcagggatttaaacgaggtgccatcgtcgtatgacacccgtgtgttatagcgttttatccgtttccgcaataagtgcatgtaaataaggctgcgcgttttcatcgcttttaccaggaattttaacgatatagggttttccggtgatggacgacgacgacgcgactttatcgataaactgttcagcggtgtcgatacgattgcgcgtgttacccagttttaagcgcaggtgcgatacggcttcctcgcagttatgcgcatcaccgttacgaacgaaggtcagatcctttttctgcgccagcacattaagcatggcgttaatgcgcgcttcttcatgggcgtttagcttcgcccaggcggggagggtcagcaggagcgcgacgacggcgcagacaattttcttcatggtaaaatcctttttcatgcaataatcactgcacctcagaccgttagccgggtaataagttgcactcctggtgtggttatttctgtgagtgcgccagcgtgagttcatccagaaaacgccacagcttttcattcatctgctgataattccatgcgcgcatctcggcgaccgagcggataaaacgcttcccttgcgcgtcggccagctcctgctgcgaatgttggattaatccttcaaccgcctcgacggtaaattccatatgacactggaagccgtagacaaaattgccgtactgcacgatttgtcgcgggcagccctcactggtagcaagaattatcgcctggtcggttaaccccggcatgtcgttatgccagtgaccgacgataagcggggagccgaaatggttgaacagcgggtgctgttggcctgcctcggtcaggacgattgggtagtgaccgatctctttttccggactttggcacaccttggcgcccagcgcttcgccaattaactgcgagcccaaacagatccccaccacgatttttcgtgccgaaatcgcctggttaatcagatgttgctcggcctgagaatcaaagtacgggcactcttcgcgggtggtgcgcggcgactgcggaccgccaaataccacgagcatatcgaactcatctgcattgggcggtagcgcttctccggcatagacgcgcgaccatgaaatggtataaccgcgatcttcagcccatttcagataagcgccagcggattcaaacgactcatggataacaaaatgaactcgcacgttattttctcctgttagcgatttagcgcctgatggatatcagccgccagcgtgttgatctcgccgtcatttaatgtcgacagcgtgatacgtagaccgtgagacggcgcgcttacgccaaaggcttcgccctcacgtaccagccagccggattttgccagcgtaaacgcggtagcctggctatgggtgtccagcgggagccaggcattcacgccgtcgccgggagaaatggcgatgccatattgctgtagggcgcgggccagtttttgttgccgggtggcgtaaaacagccgcgtttgcgccagcctgtgctgatactcagggtcggtcaggcaggcgtagaccagatcctgtaacagatggctgacccactgactaccggcatttagccgcagccgaagttttgccgaggtcgagctgtcgctggcgacaatagcaagacgtaaatcggggccgagggctttggaaacggagcgtatcaccgcccagtgttgcgttgtctgcgcaataaccggctgccagggcgacgaagaaagcagggcgaagtgatcgtcgataatgaccagtacctgagggtaacgcgccagtatattttgcagcgcagcggcacggcgagcgctcaggctacagccggtagggttgtgtgcgcgcggcgttaagatcactgcccgcgcgccctggtttagcgcctgctccagcttttcaggctgcattccttcgctatccacactgaccgggctggcgctaaaaccggcatagcgcagcatattgatactgcttaaaaaacagggatcttccaccgcaacgctgtcgcccggcagcagatgcgcgcaaagcagtctttcgatagcgtcgatagctccgctggtgatatcaatttcgcctgcgacgggggtggcatcccgtagccagcgcgccgcccaggcgtgtagttcaggggaaacgggcgcatcgccgtagagatgcggcgtgcggctgagacgggcaaaataacggctaaggtcaggcagacgctgcggatcgggattgccgccggaaaggtcgtgcagaggcgtatgcggatcgccgccttccaacgctacgggagacggactgcctttaatcaccgtcccattgcggcctaaactttgcgccagtcccgccgttatcagccgtttatacgccgctgcgacggtattgcggttcacctttaattcgcttgccagctcccgtaccggcgggagcgaatccttcgcccgtaacgtgccggcgataatgtgttgacggatactgtcaaaaatttcgttagcggtttttccgtcgatcattattgacctatgacaaaatgaattttagcatatgacaatgataatgaggcggtagcctgctgtccagcgagaggaaaattttatgggacaagagagtgatattcagtcagtgctcttcgacgacaaccatcgggcgttacagaccgatatcgtcgccgtccagtcacaggttgtgtacggcagcgtaggcaacagtatcgctgttccggccattaaagcgcagggattacgcgtgacggcggtcccgacggtgttgttcagcaatacgccgcactataaaacgttttatggcggcattattcccgccgagtggtttgcaggctaccttacggcgttgaatgagcgcgatgcgctacgtgaattaaaagcgattaccaccggttacatgggcagcgcagaccaaattgtcttgctttcgaagtggctaatggcgatccgggcttcgcatccggaggtgtgtattcttgttgatcccgtcattggcgataccgacagtggaatgtatgtgcaggcggaaattccgcaggcttatcgcacacatttgttgccgcaggcgcaggggctaacgccgaacgtatttgagctggagatgctgagtggtaaaccgtgtcgcacgctggaagaggcggtggcggcggcgcaatcgctgctttccgatacgctgaaatgggtggttatcaccagcgcgccgggcgaatctctggagaccataacggttgccgtcgttaccgcgcaggtcgtggaggtctttgcccatccgcgggtggcgacggagttaaaagggacgggagatctcttctgcgccgagctggtcagcggtattgtgcagggaaaaaaactgacgaccgcggcaaaagatgcggcgcagcgcgtgctggaggtgatgacctggacacagcagtgtggctgtgatgagttaattctgccgccggcaggggaggcgcgatgaagagttatcggctggtggttcgccagcaggggcgtatcgtggggcattttgaaacgagcgggctggacgcgctggaagatatctgcgtggcgcgagcgatgtttggcatcactggcggctatcagtgcgagttgcaagtgtccgattccgaacgcaggatactggagagtggcccggatgggatgaagatcctgatgcgcgagaagtgctttcgcccggtgacctcgcagttgtaacccgtggattggcgctgaaatgttcgcaaccttgtaggcctgataagcgtagcgccatcaggcagtgcgccgcaccatcgccggatggcggcgcaagtacaggcaaaaaaaatggcgcccaaaggcgccattcttcactgcggcaagaattacttcttaatgcggataaccggagtttcacccacggtcacgctaccggacagtttgatcagttctttgatttcatccatgttggagataacaaccggagtcagggtagacttggctttttcttccagcaacggcagatcgaactcgatgaccggatcgccaactttcacgcgctgaccttcttcagcaatacgcttgaagccttcgcctttcagctcaacggtgtcgataccgaagtgaacgaacagctcaatgccgctatcggattcgatagagaacgcatggttggtttcaaagattttgccgatggtaccgtcaacaggggcgaccattttgttaccggttggtttgatagcgatgccatcaccaacgattttttcagcaaaaactacatccggcacgtcttcgatgttgacgatctcgccagagagcggggcaacaatctcaatagttccggtgtctttcttatcatcagaaaccagagattttagtttatcgaacaaacccatgatcttctcctaagcagtaaattgggccgcatctcgtggattagcagattgttttttcttcaatgaacttgttaaccagcgtcattaactcgtccgttgtcggttgagcaagagcctgctctgctaacaccttcgcatcttcgaagttcgtgttacggataatcttcttaatgcgcgggatagaaatggcgctcatagagaattcgtccagacccatccccagcaacagaagtgtagcacgttcgtcgcctgcaagctcaccacacatgccagtccatttaccttctgcatgagaagcatcaataacttgcttgatcaagttcagtacggacggtgacattggctggtaaaggtgtgaaatcatatcattaccacggtcaactgccagggtgtactgcgttaaatcattggtgccgatactaaagaaatcaacttctttggctaaatgacgcgcaattgtcgccgcagccggtgtttccaccatcacgccaatctcaatgctttcgtcaaatgctttaccttcgtcacgcagttcctgtttgtagatttcaatctctttgcgcagcgcgcgaacttcttcaacagagatgatcatcgggaacataatgcgcaatttaccgaaagcggaggcacgcagaatcgcgcgaacctggtcacgcaggatctctttgcgatccatggcgatacgcacggcgcgccagcccaggaacgggttctcttctttcgggaagttcatgtatggcagctctttgtcgccgccaatgtccatggtacggacgataaccgcctgcgagccgcacgcttcagcgaccgctttataggcggcaaactgctcttcttccgtcggcagcgcgtcgcgatccatgaacaggaattcagtacgatacagaccaacgccttccgcgccgttacgctcagcgccttcaacgtcacgaacggtaccgatgttggcgcaaacttcaacctgatgtccatccagcgtgattgccggcagatctttcagttttgcgagttccgctttctcggtcgcaacctgctcctggacggcgcgcagttgctcaataacatcgttggtcgggttgacgtaaacctggttgtttacggcatccagaatcagatagtcgccgtttttcacctgagcggtgacgctaccggtacctacgatcgctggcagttccagagaacgcgccatgatggaggtatgagacgtgcgtccgcccgcgtcggtgatgaagcccagcactttctgcaggttcagctgtgcggtttctgacggcgtcaggtcagcggcaaccaggataacttcttcctgaatcgcgctcagatcgataatggccagacccaggatgttgcgcagcaggcgcttaccgatatcacgtacgtcagccgcacgctctttcaggtattcgtcatccagttcttccagggcagtggcctgaccttcgataacttcatgtgcggctgcgtcagccgtcatgtgcttatctttaatcagggctatgatttcctgctccagctcctcatcttcgagcagcataatatgcccttcaaagatggcttctttttcttcaccgaacgtttcaccagcttttgtcttgatcgcttccagttgcgcagatgccttggcacgaccgctcagaaaacgttcaacttcctgatcaaccttgtcggcagaaatttttttccggtcaatgacgatttcgtcttctttcagcagcagtgctttgccgaaagcgatacccggggatgctaaaatgcctgaaatcataaccctaccttacttgtgactgatttttaaaagaacccggaaaaaaacttactcgagttccgccatcagtttgaccagatgttcaaccgctttctgctcatcttcaccttctgcggagatggtgacgacggtgccttgagtcaggcccagagtctgcagtttaaacaggcttttcgcgctggcgcttttgccgttggaagtcacagtaatctcagaagtgaagccttttgcttctttaacaaactgagcagcagggcgggtgtgcagaccgttcggagcggtaatggtaacttcttgctggaacattgtatttccccaacttataggtttagtgttgtggaactaaagtctagcctggcggctcaactttagcctgtattgttagcgccggcgtaaacgggacgcgacacaaaaggtgttctacgcaatccgttgctggcaacttatggccgctgacgtttcgctcgtcattaaacattatgccgcgaaaggaagagttgaaccaaatcataaaatcgattcagctaacgcttttcctgtaacgattaatttcgcgcatcaaaataattagtctggttaaataccagttccggcagggtgaatcaatgccaggtgaggtgaaagtttgaagcaggccacaaaaaagcacccaaaaaggtgcttttttacgcgtttttaacatgctggcatcactgttgcagttctttctcagtaaagagatcggcgaacaacgcggtgctcagataacgctcacctgatgagggtaggataaccacaatattcttattggtaaagctttcatcttcctgcagcttaagcgctgcagcaaccgcggcgccggaagaaattcccgccagaataccttcctcttccatcagacggcgcgcggtagaaatggcttcttcattggtgatgccaaccactttatcaatcagtttcagatccaggttgcccgggatgaagcctgcgccgatgccctgaattttatgtgggcccggtttgatctcttcaccagccagcgcctgggcgataaccggggagtcagtgggttctaccgcaacggtgataagatcggttttacccttcgtccctttgatataacgcgtgacgccggttaacgtaccgccagtgccgacgccggagataaacacatccacctgaccatcggtgtcttcccagatttccgggccggtggttttttcatggatttccgggttggcagggttgctgaactgctggagcaggagatatttttgcggatcgctggcgacaatttcttcggctttctgaatagcgcctttcatccctttcgccccttcggtcagcaccagattcgcgcctaatgctttgagtagcttgcggcgttcaatgctcatggtttccggcatggtcagggtgagtttgtaaccgcgcgcggcggcgacatacgccagcgcaataccggtattgccgctggtcggctccaccagttccacgccaggtttcagtacgccacgcttttcggcatcccaaatcatattggcgccgatacggcacttgacgctgaagctcgggttgcgcgactccaccttcgccagaatgcgtccattaccgatacgattcagtcgaaccagcggcgtatgaccgatagtcagcgagttatcttcataaatcttactcatggcctgtccttaactgtatgaaattgggataccttcccagcataccttccagccagatatggggaagtaaggatttcgcatatctatatgctgatggggaataatggttatcagtatggaataagagacagcataagagcctatcccattagggctattttacttgccattttggtcctgggcagtgctcgccaaaacgcattagcgttttgaacgccgcttgcggcggcccgaagggcgagcgtagcgagtcaaacctcacatactacgtgtacgctccggtttttgcgcgctgtccgtgtccaaactggctgcgccaataacgcttggtgggataggctctaagccatctcttatttatacatttttacgttatttccataacgcgtgtttagcacgccagcaatcaacccacattgccgtcgcgccacagacggcgacaggcataatgaaaaggttaagcaccggaatcatcgtaaagaggctggtgagcgcgccaaattgcatattcgccaccttctgcgtgcgcaacgcggcgcgcatcgttttaaacggcactttgtggttatcaaacgggtagtcgcaatactggatcgccagcatccaggcgctgaacaaaaaccacagcaccggcgcgatggtttggccaatgccaggaataaaatagagaaccagcagcacaatagcgcgcggcagataccacgccagcttttgccattcacgtttcataatgcgcggtacatctttcatgatgccgagtatgccggtatctggcggcgtagcgccggttaaccgcgcctcaagctgttcggctaaaaggccgttaaacggcgcggcgatccagttggcgagggtagagaaaaaatagccaaagaccaacagaacagagataaccgcaatcggccacagcagatagctcagccattgcagccagtccggcacatgactcatcaacgaaggtatccaggcgtcaagctgggtaaacagccaccaaaatgcgccgcccatcagcacaatattgaccagcaaaggtaaaataacaaagcggcggattcccggtagggtgactaacttccatccttgcgagaaataatagacgccgctacgtggtacggttgtggatgatgaaaccatattcaggacatactcctttttcttaaagccctgggtaaacgtgggatatcttacccggttatcagacggtggatagttcggaaatgttcgaaaaaacagcaaaaagcacattttccttcatctttatgctgcgaaagccaacagtacacttgcacttgacgtaatcggcaaatactcttagtgagtaaatgtttgccgtggtggcaaggtgttagaacaacagagaatataatgatgcaggatttgcgtctgatattaatcattgttggcgcgatcgccataatcgctttactggtacatggtttctggaccagccgtaaagaacgatcttctatgttccgcgatcgtccactaaaacgcatgaaatcgaaacgcgacgacgactcgtatgacgacgatgtcgaagaagacgaaggcgtgggtgaagttcgtgttcaccgcgtaaatcatgcccccggccagtcgcaggagcatgatgcccctcgtcagtcgccgcaacaccagtaccagccgccttatgcgtctgcgcaaccgcgtccagcggcgccgccgcagccgcaagcgccgatgcaacagccggttcagcaaccggtccaacctgcgccgcagcctcagcaggttcagccatctgcgccgccggtacagccgccgcaacagcagcctgcaccgccgtcgcaagcgccgcagcctgttgcgcagcccgcgccgccgccatcagcgcaaaccttccagcctgcggaacctgtggttgaggcggaaccggtagtggaagaagcgccggttgtggaaaaaccgcagcgtaaagaggcggtcatcattatgaacgtcgcggcccatcatggcagcgagcttaatggtgaagtgttactgaacagtattcagcagtcaggctttaaatttggcgatatgaatattttccatcgtcatttgagcccggacggcagcggcccggccttgttcagtctcgcgaatatggtcaatccgggaacgttcgatcctgaaatgacggacttcactacgcctggcgtcactatctttatgcaggtaccgtcttacggcgatgcgctgcagaatttcaagctgatgctgcaatccgcgcagcatatcgctgatgaggtcggtggcgtcgtgctggatgaccagcgtcggatgatgacgccgcagaaactgcgcgaatatcaggaccgcatccgcgaggtgatggacgctaacgcctgaggttaacgcaggtgtgacatttttaacgtaacccccgcctgtcgggggttttttatcattgatggtgtgatatggaaccaatcgaacaacaactgacagaactgcgaaccacgcttcgccatcatgaatatctgtatcatgtgatggatgcgcccgagattctcgacgccgaatatgaccgcctgatgcgggaactgcgagagctggaggcgcaacgtccggaccttatcacgccggattcgcccacgcagcgcgttggcgcggcgccgctgacggcattcaaccagattcgccatgaagtaccgatgctgtcgctcgataacgtatttgatgaagaaagcttcctggcgtttaacaagcgagtgcaggatcgtctaaaaagcacggaaaatgtcatctggtgctgcgagctaaaactggatggcctggcggtcagcattctgtatgaaaacggcgtgctggtgagcgctgcgacgcgtggcgacggcaccaccggtgaagatatcacttcaaacgtgcgcacgattcgcgccattccgttaaagctgcacggcgataacattccggcgcgtcttgaagttcgcggagaggtatttttaccgcaggccgggttcgaaaagatcaatgaagacgcgcgccgtactggcggcaaagtgtttgctaatccgcgtaacgcggcggcgggctcgttgcgtcagctcgatccgcgtattacggcgaagcgaccgctaacatttttctgctacggcgtcggtattctggaaggcggagagttgccggatacgcatctgggacggttgctgcaatttaaagcgtgggggttaccggtcagcgatcgcgtgacgctgtgcgattctccccaggcagtactggatttttatcacaacgtcgaaaaagatcgccccacgctcggttttgatatcgacggcgtggtgattaaggtcaactcgctggctttgcaggaacagctgggctttgtggcccgcgcgccgcgctgggcggtggcgtttaaatttcctgctcaggagcagatgacttttgtgcgcgacgttgagtttcaggtcgggcgcaccggggcgattacgccggtggcgcgtctagaaccggttcaggtggctggtgtgctggtcagcaatgccacgttgcataatgccgatgaaattgagcggcttggcttgcgcattggcgataaggtggttatccgtcgggcaggcgatgtgatccctcaggtggtcaacgtggttctgtccgaacgccctgaagagacgcgtccgattgtgtttccaacgcactgtccggtgtgcggatcggacgtagagcgcgtcgaaggcgaagccgttacccgttgtaccggcgggctgatttgcggcgcgcagcgtaaagagtcgctgaaacattttgtgtcgcgccgggcgatggatgtagacgggatgggcgataagatcatcgaccaactggtggaaagggagtatgtccatacgccagcggatctgttccgtctgacggcgggtaaactgaccggcctggaccgaatggggccaaagtccgcgcaaaatgttgttaacgcgctggaaaaagccaaagcgacgacttttgcgcgttttctctatgcgctgggcatccgtgaagtgggtgaagcgacggcggcggggctggcggcgtacttcggcacgctggaggcgctgcaggctgccaccattgacgagttgcagaaagtacccgacgtggggattgtggtcgctacgcacgtctttaacttttttgccgaagagagcaatcgtgacgtgattgggcagctactggcggaaggggttcactggcccgcgccggtagtcattaatgcgcaagagatcgatagcccgtttgccggtaaaaccgtggtactaaccggtagcctgagccagatgtcccgcgatgacgctaaagcgcgtttagtggctctgggcgcgaaagtggcaggcagcgtatcgaagaaaaccgatctggtgattgccggtgaagcggcgggctccaaactggccaaagcgcaggaactgggtattaccgtgattgatgaagcggaaatgatccgcttactgggtgcctgagatggaaaaagagcagctgcttgaaatcgccaacaccgtgatgccctttggcaaatatcagggacgtcgattgatcgaccttccggaagagtatttgctgtggtttgcccgtaaagatcaatttccggcgggtaaactaggggagttgatgcaaatcacgctgctgattaaaaccgaggggctgacgcaactggtgcagcccctgaaacgcccgctttaagctttcgcggcgcggctttcctgctgcgcctgtaacttctcggtctggcgtttgtagcgccgcgccagccctgcgcagaccatcagttggatctggtggaagatcatcagcggtaataccatcatacccagcactgacgtcggaaacagaatattggccatcgggatcccgttggccaggctttttttcgaaccgcagaagacaatagtgatttcgtcggctttattgaagccgcatttacgggcgacaaagacgttaatggctatgacgatcgccagcagtatgaggctgaccacgacgataaacagcagcgatccccagccgactttgtgccagatgccgttgaccaccgcttcgctgaacgccgagtagaccaccaacagaatagaggtctgatccgttttcgcgatccactttttgttgcgcgcgacccaattgccgatccacgggcgagacaggtgtcccagcacaaaaggcagcagcagttgcagcataattttgcccacctcttccagactgccctgcgcgccatgaatattcattaccagaccgaccagcagcggcgacaggaaaatgcccagcaggctggacgcagacgctgagcacaccgcggccgcgacgttgccgcccgcgagtgaagtaaatgcaatcgccgactgcacggtggcgggcaaaatacacagatacagaaagccgctgtagagcatagggtcgacattgacaggcgcccaccaggcaaacagcacgccgaggacaggaaagagcacaaaagtgctgcacatgacccacagatgcaaccgccagtggctgccgccagcgatgatcgcttcacgcgaaagcttcgcgccatgcataaaaaacagcagagcgatagccgctgtcgtaatgccttcaacgacaggcacaaagccaccttccgccgggaaaaaagaggccagtagtaccacggtgataagtgtcagcgtgaaagggtcaaggatacgaaaaagtttcataaaaactcctgaaagtcggtgcagctattttgcgtttttcgctttgagaaataaaattgatttattgcatctatatatgaatctagtcgatgaactattcactgcgtcaactgcggatttttattaccgtcgcccaggccaaaagttttagtcgggcaggggacaggattggactgagccagtctgcggtcagtcatagcgtaaaagagctggagcggcaaaccggcgtcagactgttggatcgcaccacgcgtgaggtggtgctgaccgaggcggggcaacagctggcgacgcgtctggagcgggtgcttgatgaactgaacagcatactgcgcgatgcaggcagagtagggacacaattaaccggcaccgtgcgcgttgccgcgagccaaaccatttctgcgcatcttattccgcaatgcattgcccaaagtaattcactttatcccgctattgattttgtattgcacgatcgtccgcagcagtgggtgctggagagcatccgccagggtgaagtggattttggcatcgttatcgatcccggcgcagcggtggatttacagtgtgaagccatcttatcagagccttttttactgttgtgtcgccaggatcatccgctggcgcatcaggaatgggtgagctggcaggatcttaaacaggcctcgctggtcttacaggattatgcttccggcagtcgaccgctgattgatgcggcgctggcccattttgctattgaggcggatatcgtgcaggagattggtcacccggccacgctgtttccaatggtggaagcgggaatcggcatcagcgtgctgcccgcgctggcgttaccgctcccgcagggcagccacttacaggttaaacggctgacgcccgtagttgaaaggcagctcatgctggcgcggcgaaaaaaccgatcgctctccacggcggcgcaggcgttgtgggacgtggtgcgtactcaggccagcgaattaaccgccgcgagggcgaaagatccgctgtatcagctataaatatctatctgtccgtgtgtgaggtgcggtcttgccctgccatttttgacagggcagtgtgttaaaacaggtatttgatggaataaataatgccatcctgcaggaaggattctcctaacttattatcagcgtaacgatattgtactcctgcggtcaggtgaggagtcgcattccaccacagcgctactgcgccattaatgccatctttcccgccattgcccgcagcgtaggacgcatcgcggtcaaactcatactcattccagttcgttacgctgaatttctcactacccaacgagaagctatagccggccacccaacctaatacataaccattatcgcctgtgtagtaggtctgatcggtataacgtttggcaaagaagggtttaaaccagtaaccgttacctgtgaagttatagcctaaaccatagagaaacatgtcatcatggaaattagcgcgatgaggtgaaccgtacgtcccgtaggcatggagatagaggtttaatcctgtatcgcccagataaatacggttggtatttttaaaggtgtaacgctgttcgctgcttggtttagcgtggcggccattgtaaaaattttcccagtcgaagaacccgtacatttctccccagctaaaattcgctccgccttccagttccaggtacccaaaatcatctttatgggattttttactggttttttccgtggtgtctgatgtccagtcgaggtaatggaggccgatatcggcgaacccgcctttaaattccgcatgggtgagtgcgggaataatgagtaaagaagaaagcgtcagagtaagaatttttttcatagcatatttccctatgccgataattattaatgggttaattaaaaagaggcaatttataaatatgaaagcggcatattgttaatatgaagtgcaagcaaaaaccaatactgttttccctctgtattaatacagaagcgatctaaatctatcgatattaaatggctattgatgacacgtgaaaagtgtattggtcagcaaggggcgatggtcgttataaaaaggagtcaaattaaatccgatagaacaaggaaacttatgcctcacgctcttttttctcataatcctgagtattgtattgatattattcatgcacataaaccggcatttaccccgcgagtcgcgtttattttaggctccgggttgggtgctctggcggatcaaatcgaagatgcggtagccatttcttacgagaaattgccgggatttcccgtcagcaccgtacacggccatgctggtgaactggtgctcggccatctggcgggtgttccggtggcctgtatgaaaggccgcggacatttttatgaagggcgtggaatggcggtgatgaccgatgccattcgcacgttgaaattactgggctgtgaagtgttgttctgcaccaatgcggcaggatctctgcgtccggaagtggggccgggtagcctggttgcgcttagcgatcacattaatacgatgcccggtacgccgatggtggggccaaacgatgatcgttatggcgatcgcttcttctcgctggctaatgcttatgacgcagattatcgcgccatgcttcagtccgttgcggcagagaagggattccccctcactgaaggcgtatttgtttcttatccgggtccgaacttcgaaacggcggcagaaatccgcatgatgcagattattggcggcgatgtggtcggaatgtccgttgtccctgaggtgattagcgcacgtcattgtggcctcaaagttgttgccgtctcagcgatcaccaatctggcggaagggctgggcgatgtaaaactctcccatgcgcaaacgctggcggcggctgaactttcccggcagaactttatcaatctgatttgcggctttttacgtaagctggcctaaacacaatgactacggccccgtattggggctttatctcacggcaaggaataaaaaatgggtattacgtcccgcttaaaagtcatgtcgttcttgcaatattttatctgggggagctggctggttaccctgggctcttacatgatcaacactctggattttaccggcgcgaatgtcggtatggtctacagctcaaaaggactggcagcgattatcatgccgggcattatggggatcattgctgataaatggctgcgcgctgagcgagcctatatgctttgccatctggtttgcgcgggggcgttattgtacgccaccaccgttaccgatccccagacgatgttctgggtgatgttggttaatgcgatggcgtatatgccaacgattgcattatccaatagcgtttcgtactcctgtctggcgaaagcaggtcaggatccggtaacgtcatttccgcccgtgcgcgttttcggcacaataggttttattgttgcgatgtggacggtgagcctgatggggctggaactgagcagtgcgcaattatacatcgcttctggcgcatcgttattgctggccctgtatgcgctgacgttaccgaaaattccggtagccgagaagaaggcgaacaccacgcttgtcagtaagctcggactggatgcttttgttctgtttaaaaatccacgcatggcaatcttctttttgtttgcgatgatgttgggggcggtgctgcaaattaccaatgtcttcggtaatccgttcctgcatgattttgcccgtaatcctgagtttgccgatagttttgtggtgaagtatccctctatcttgctttcagtttcgcagatggcggaagtgggctttatcctcaccattccgttcttccttaaacgctttggtattaaaacggtaatgctgatgagcatgctggcgtggacgctgcgtttcggcttctttgcctttggcgatccatccccgtttggctttgtgctattgctgctgtcgatgattgtttatggctgcgcatttgatttcttcaacatctcagggtcagtatttgtagagcaggaggtggactcaagtattcgcgccagcgcgcaggggctgtttatgaccatggttaacggcgtgggggcgtggattgggtctcttttaagcggtatggccgtggattatttttctattgatggcgtaaaagattggcaaaccatctggctggtttttgccgcctacgctctggcattggccgttatttttgcattgttctttaaatatcagcaccatccagaaaaactgtcgaccaaatcattagcacattaattttatttgactggcgagaggatgttcgccagtccatttttatgaacaaggacacagtatgaaagaaattattctctcctccggtattggatttggtattggcgcattttttactttatgccgtatacctattcctgcaccaaatgttttacccggggttttatctattgtatttatgtatattgggtatcttgtcgttaaatctattttttactaggtaatatggtaaattccagacgttatcccttattcctggagtgcgatagtgatggaacgagcccatcgtattgatctaaagctattacgttatttcctcgctgttgcagaagaattgcattttggccgggctgctgcccggttaaatatgtcacaacctcccttgagtatccatatcaaagaacttgaacagcaactgggtacattgctgtttattcgtcattcccgcagcgttgcattaacccatgccgggaaagttttaatggaggagtcacgtcgcttgttagccaatgcaaatcaggcgctggcgcgagtggagcagattggtcgcggtgaagcggggcgcattgaactgggtgtggttggtacggcgctgtggggaagaatgcgtcctgcgatgcgtcactttttgaaagcaaatcccaatgttgaagtactttttcgcgaaaagtctccaggtatgcaaatggcgttgttagagcgtcgggaacttgatgcagggatctggcgtatggctatcgaaccagcagtcggttttaccagcatacgtttgcatgaatctgcattcatggttgcagttccggaagatcacgatctggcatccagagattctgtgccgctgtcggcgttgcgcaatgaatattttgttacgttgccttccgtacattctgattggggatttttacaacgtgtatgccaacaggcgggtttctcgccaatgattattcgggaagtggttgagccgcaaacggtgttggcgatgatcagtatggggatcgggattacgttgatggctgatggctatgcgcaaatgagctggccgggtgtggtgttccgtccgttagaggaacgtattccggcggatttgtatattgtgtatgaccagcagcaggcaacgccagcactggagaaactggtggcggcgttgacggtatgatgtctgtgccggatggcgactaacgtcttatccggcctacgcggcggtgtcgtctgtaggcctgataagcgcagcgcatcaggcaagacccgaacctgcggcaggttcgaatcttataaatcgcagatagcaaaaaagcgcctttagggcgcttttttacattggtgggtcgtgcaggattcgaacctgcgaccaattgattaaaagtcaactgctctaccaactgagctaacgacccgaagtggtgggtgatgacgggatcgaaccgccgaccccctccttgtaagggaggtgctctcccagctgagctaatcacccacttcggtacttcacaataagaaatttagctggcgagaaagtggtgggtgatgacgggatcgaaccgccgaccccctccttgtaagggaggtgctctcccagctgagctaatcacccacttctcaatttcttatctacacggcggagactacataaagtagttggtgggtgatgacgggatcgaaccgccgaccccctccttgtaagggaggtgctctcccagctgagctaatcacccccgctgtgtggagtcgcattatagggagagttgaaaatgagtcaacgcattttctaaagtttttgtttgttcgtcgtaaaattaaacaaaacgatcgtgaattaccccgcactgcatgatttctatacggaaatagcaaagcgcagcgttctgaccggatcaacattgaggaatcaagccacagtgatagaatacaaggctattcatctttccaggatttgccggttgtcggcatctttataaacgtaaggccatttcatgaaaatcaaaactcgcttcgcgcctagcccgacaggttatctgcacgtcggcggcgcgcgtactgctctttattcctggcttttcgcacgtcaccacggcggtgaattcgtgctgcgtattgaagacaccgatcttgagcgttccacgccggaagccattgaagccatcatggatggtatgaactggctgaacctggaatgggacgaaggcccatatttccagaccaaacgttttgatcgctataacgcggtgattgacgagatgctggaggcgggaacagcctataaatgctactgctctaaagagcgtctggagcaactgcgtgaagatcagatggcgaaaggcgagaagccgcgttatgacgggcgttgccgtcacagccacgaacatcatgccgacgatgagccatgcgtggtgcgctttgccaacccgcaggacggttccgttatttttgatgatcagatccgtggcccgatcgaattcagcaatcaggaactggacgatctgatcattcgtcgtaccgacggttccccaacctacaacttctgtgtggtggtggacgactgggatatggaaattacccatgtgattcgtggcgaagaccatatcaacaatactccgcgccagattaacattctgaaagcgttaaacgcgccggtgccgatgtacgcgcatgtgtcgatgattaacggcgacgacggtaaaaagctgtctaaacgtcacggtgcggtgagcgtgatgcagtatcgcgatgacggttatctgccggaagcgttgctgaactatctggtgcgtctgggctggtccagcggcgatcaggaaatcttcacccgcgaagagatgatcaagctgttctccctcggtgcggtgagcaagtctgcgagcgcgttcaacaccgataaactgctgtggctgaaccaccactatatcaatacgctggcgccggaatatgtggcgacgcatttgcagtggcatatcgagcaggaaaatatcgacacccgtaacggcccgcagcttgctgagctggtgaagttgctgggcgaacgctgcaagactctgaaagagatggcgcagagctgccgctacttctatgaagacttcagcgagtttgacgccgatgcggcgaaaaaacacctccgcccggtggcgcgtcagccgctggaagtggtgcgcgacaagctgtcggcgattacggactggtcagcagaaaacgtccaccacgcgattcaggccacggcggatgagctggaagtggggatgggtaaagtagggatgccgctgcgtgtggctgtgaccggtgccgggcagtcgcctgcgctggatgtcaccgtacatgcgattggtaaaacccgcagcattgagcgtatcaacaaagcgctgggctttatcgccgagcgtgaaagtcagcagtaacgccagctgaaacagaataaacggcagggcagacgcctgccgtttattatttgttagtccgcctcattgatacctaaacgcgtcagaaatccgcgaataccttcccgcgataaaaacagcgccagtttttcctgttcctgagcagacatattttcaacggcatcaataatttgtcgataagcgtgactgtgcgtcgcgttcgcatattctgcgaaagcctcttccgcctgataaaacgcaggcagtttgcgaaaagccggaatattgagaataaactcccgcacgctggcatcaatatggatgagtcttgcgcgtccgcctttgacgccgggaaatttttcggttttccagtgttgttctctgatccagcgattgacggtttgtctggccacgccgaggcattcagccagctcttcagtggtcattttactgcgtaatcttttcatattatttgctatcgcgtatccctaagcgttgtaacaaaccggtaatcccttcacgcacgaggagagaggtaaactgtttctgctcggatgaggtcatctctttggcgagcgtcatgagcagcgcttcaagcgatgcgttgctggcaggcgtgaatgtgtctgcgtgatggtcaactgaacgttcagcgctgcggatatattcacgaacctgttcgtttacatgaaccagacgggctttaccgccctggacgccaggtttgggcgatgttgcccagccttctttccgtacccatttattgatggtttgtcggctgtaaccggtgagattagcgagttcttctggcgtcatccgttccttgaacataacgattccctgaatagtcgtggggttaattagtggttcattttatagcaccattttagtcgaaaccgtgacgtgtttaactactgaatgcgagttgtgccgcaatgtcctttatttgaatgctttttcagcgattgaattcggcaagttcattttgccgttgacacatgccgagggaattcatatgatgccgcccgtcaactcgacaagctttacgtagtggggctatagctcagctgggagagcgcttgcatggcatgcaagaggtcagcggttcgatcccgcttagctccaccaaatttactcccgataaatttggcgtatacgtaaaagcactatggggctatagctcagctgggagagcgcttgcatggcatgcaagaggtcagcggttcgatcccgcttagctccaccaacgttcaaaccctcgctgaaaagcgggggtttttgctttttgtcacaaaattcatggcgtctgatctgctcttcaggtgcgttcgtttgccgctgcttttgcggtcaatatgagcttttgttagattgcttcataatgcgaatatacttattattcatgcgccttatataatgatgtgagcattaaagcaatgccggataagtgtaacgtattaaaaaatataaaaatattcttactggccttctgcctgaccgttccggctattctgctatctcgtctcatttctccccgcgccacaattgattccagctatatctttctggcctggctaccgctctgcgtcatgttttccgtgctgtttttatttggccgccgtggcgtcgcgccgatggtaggcggaatgatgttgactaatgaatggaattttcatttacctctgccacaggcgatggtgctgctattttgccagacgtttcccgtgttgctggtttgcgctatcgtacgctggcagctgggcgcgcgctggcgctacggaatacccaaccaaggcatctggctacgcgttttctggttagggttaatgacgccgtttggtataaaaatcagtatgcatctggcggggcactacctggctttcccggtgaccatctctaccttctttggcaccggcaccgctattttctcgattgtcgatttattgagtctgatttctgccgcgcttatttttaccctctttttctattatccgctgcgaatgatagtcagcccgcactatatgcgtattttctggcggagggatgtcgctccttatctcgccaaagaaaaacgcctgtttacgcttctctggtttgccactctggcgacgctattagcggtgctgtgtacgcctttcgagacaaagtatattgctggctatctggtgccagttctgttcattggatttaccatcggcgtggggaaaatcagctatccgctgttgaattttagttgggctctcactgcgctattcctgcttagctataaccgcaattttctgcagggcgtgggttcagaatattcgctggcatttatcctttcagttctcatttcttttagtatttgtttgttgtacatggcgcggattaatcagcgtagcgaatggttgaatcgacagtggcactcgcaggcattgaccgatccgttgacgcaactgcctaacttgcgcgcgctggggcagtttcttttacaggatgccgggcaaagcgtgtgttatctacgcatggaaaacctggaatttctgagccgtcattacggtatgcagatgcgcgtgcattgcgaacgcgaggtgtttcgcgtgttgcagccgctgctgctggaaaaggagaaaattttccatctgccgggcagtgaattattgctggtattgacgggaccggagacggaagcccgcctgcaatatatgctcaatgtgcttaataaccgcaaaatttactggaacaataccggtctggacatggaatacggcgcatcgtggggaacattcgatggtcgccaggaaaccttgcaaccgctgttggggcaattaagctggctggcggagcaatcctgctcgcaccgtcgggtgcttgcactgacccagagtattgaagccgcttccgggcagacgacggaacgggtgctgcggttgcagaaaatccgtcaggcgctggagcgcggcgcgctggttttgtatgcgcaacccattcgcgacgcgcagggaaaagggtatgacgagattctgacgcggcttcggtgcgacgacggtatcatgatgccgaatcagttcattccgcttatcgcccagtttaacctgagcgtacggtttgatatgcaggtgatggaagcgctcctgcaatggttgtccgcgcatccttcggcggagcagggggcgcgtttttcggttaatttgatgccgctgacgctgctgcaaaaagagacggcgtcgcgcattatgcagctttttaaacgctatggcgtcccgcctgcttcggtcatcatcgaaattactgaagaacaggccttctctcattccgaaatcagtatgcacaatatcaaccagctgcgtaagtttggcctaaaaatcgccattgatgatttcggcaccggttatgcaaactatgaacggctaaaacgcctcaaggcggacatcattaaaatcgacggttgtttcgtaaaagatattctgacggactccctggatgcgatgatcgtgaaatccatcactgatttagcgaaagcgaaatcgttgagcgtcgtggctgagtttgttgaaacgcctgcgcagcgcgatctgctattgcagcttggcgtacatagtttgcagggatatctgattggccgcccgcgcccgttaggcaaataagcggcataaaaaaaccggggatagctccccggtttctacattaaacgcagacttacagtaccagcgccgcgatagaggcggacagtacgctcaccagcgtagaaccgtaaaccagtttcagaccaaaacgggaaaccacgttgccttgctcttcgttcaggcctttaatcgcgcccgcaataataccgatggaagagaagttcgcgaaggacaccaggaagacggagataatgccttcagcgcgtggagagagggtagaggcgattttctgcagatccatcatcgccacgaattcgttggaaaccagtttggtcgccatgatacttcctacctgcagcgcttcactggacggtacgcccattacccatgcgaccgggtagaagatgtaacccagaatgccctggaaggagatgctgtagccgaaccaaccggtaaccgttgcgaacagcgcgttcagcgccgcgatcagcgcgatgaagccgatcagcatcgccgcgatgataatcgccactttaaaacctgccagaatgtactcgcccaacatttcgaagaaactttggccttcatgcaggttcgacatctgaatattttcttcgctggcatcaacggtataggggttgatcagcgacagaacgataaaggtgctgaacatgttcagaaccagcgctgcgaccacatatttagggtccagcatggtcatatacgcgcccacgatagacatggaaacggtagacatcgccgttgcagccatggtgtacatgcggttacgggacattttaccgagaatatctttataagcgataaagttctcagactggccgaggatcagcgagctgacggcgttaaaagattccagtttgcccataccgtttactttggatagcaggaaaccaatagcgcggatgaccactggcagaacacggatatgctggagaataccgatcaacgcggaaataaagacgatcgggcacaatactttcaggaagaagaacgccaaaccttgatcgttcatactgccaaagacgaagtttgtcccttcgttggcaaatccgagcagtttttcaaacatctcggagaaaccttttacgaagccaaggccaacatccgagttcaggaagaaccaggccagtaacacttcgataacaagtaactgaatgacgtaacgaatgcgaatttttttacggtcgctgctaaccagcagtgcgagtaccgcaacaacggcaagcgccaggacaaaatgaaggacgcggtccatatttgctccaaatatgaggcaggtttaattttcgtgcacattctatgcaacagctgtaaagaaaacgagatccaacacacactataataaggacctgtgacgagattcaaaattagtgatctgtaatacacttttactgtactgaatatgaaaatgaaaagttatatcagtgtgctaatcttgtaatgttaagccaaactgttctgatacaggtcgccatcgtatcggtctatcgtttcacactatcaaagtaatcacccgtacccattgaaatgcacttgataatcattatcaatgaacatagcatgaaacatagcaaaggctatgtttttgaggcaaaagatgactgacaatcgcgtagagaatagcagcggacgggcggcgcgcaagctaaggctcgcattaatgggacctgcgttcattgccgcgattggttatatcgatcccggtaacttcgcgaccaatattcaggccggcgccagctttggctaccagctactctgggtggtggtctgggcgaacctgatggcgatgctgattcaaatcctctcggcaaaactcgggatcgccaccggcaagaacctggcggagcaaattcgcgaccattatccgcgtccggtagtctggttttactgggtacaggcggaaatcatcgcgatggccaccgatttagctgaatttatcggcgcggcaataggttttaagctgatcctgggcgtctctttactacagggcgcggtattgaccggtatcgcgacgtttctgattttaatgttacagcgccgcggtcaaaaaccgcttgaaaaagtcatcggcggtttactgctttttgtcgccgccgcttacattgtggagctgtttttctctcagcctgatatggcgcagctcggcaaaggaatggttatcccggcgctaccgaacccggaagccgtattcttagccgccggcgtgcttggcgcgacgattatgccgcacgtgatttatctgcactcgtcattaacgcagcatctgcacggcggaacgcggcaacaacggtactcagcaacgaaatgggatgtcgctattgccatgacgattgccggttttgtcaatctggcaatgatggcgaccgccgcggcggcgtttcattttagcggccatactggcatcgccgacctcgatcaggcatacctgacgctggaaccgttactaagccatgcggcggcaacagtgtttggtcttagtctggttgcggcagggctttcctccaccgtggtagggactctggcggggcaggtggtgatgcaagggtttgtccgttttcacattccgctgtgggtacggcgcaccattaccatgctgccctcatttattgtgattttgatggggctggaccctacccgaattctggtgatgagccaggtgctgctgagttttggtattgcgctggcgctggtgccgctcctgattttcaccagtaacgctacgctaatgggcgagctggtgaacacgcggcgggtaaaacagattggctggataattgtcgtgctggtcgtcgccctgaatatctggttgctggttggaacggtgatggggttgtcataaagacagaaagatagcaggcccgatgcgtgggcgtcatcgggctgttattcagcaggaggcttagtgatgatgtttgtgaccccggcctcgcccgcgatgatcgtcgcgatcgcgccagccttcccgataaccgcgttcatacgctttacgcttatcccagccgcgatgatagccgttgtcatggcgccaccagcgatttttacgccattcataatggttgtgccagtaatcccggtcgcgccagcgaccaccgtcccagtagttaccgtaatcatcgcgatcgccaatctgtaattttattgagggcaacagggtgatttcgcccgcattcgcggcaagcggtgtaaaagccagcaaggctgccgccagaatcagtgacctgaacatactttctctccttcacgatcgagccgtcgccggcctgttaatgcaatattacaaagcagtaaagatttgtttcatcgccttaactcttaaatcatgaaggagagcattttttgctaaaaccggccctccagaatagcgtcaatttctgcacattccgccgccgaaaaacggcgattggccagcattcctacggcgtcttcgatttgcgacggtttgctggcgccaatcagtaccgaggtaacgttatcgttacgcagcacccaggcgagcgccatctgagacaatttttggccccgtcgtgcagccagttcattcaaccggcgaactttttccagtttgtcggcggtaatctgttctggtttaaggaaacggcttccgctcgccgcgcgggaatcttccggaatgccattcagataacggtcagtgagctgcccgcccgccagcggcgagaaggcaatactgccgacgcctttttcctgcaacagcgtcagcagcccgtcctctacccaacgctcaaaaagcgaatatttaggctgatgaatcaggcaaggcgtgccgagatcctccagaatatcgatagcttgtctggccagatcggcaggatagttagagatccccacgtacaacgctttgccgtggcgcacaaggtgatctaacgctttcatcgtctctttaagcggcgtttcgggatcgggacgatggtgataaaagatatcgacatactccagccccatacgtttcaggctttgatcgaggctggcgataaggtatttccgtgaaccccagtcgccataagggccatcccacatggtgtagcccgctttggtggagatgactaactcatcgcgccacggtaaaaaatcttcctgcagaatgcggccaaaattgcattctgcggagcccggcggcggcccataattattggcgagatcaaagtgggtaatgcccagatcgaacgcgcgttgcagcagcgcccggctattttctacccgtgtcgtatcgccgaagttgtgccataaccccagcgaaatagcgggaagtttgacgccgctgcgcccgcagcgacgatactccattgtgtgataacgattctcatcgggctgataaatcatgacctttccccctgtggcgtgaataaatagtgtatacggttacactcgccaggcggtatccggcttttactgtttgccgctgtaaacattgttttccaggctttcatccccgccgtgctggacagccatcggcattccttaatactcaacataatgtcaacgtcagaaggaaagctgtcatgcaaaacccctataccgtggccgactatttgctggacagactggcaggatgcggcattggccatctttttggcgtaccgggcgattataacttgcagtttcttgaccatgtgattgaccacccgaccttgcgttgggtgggatgcgccaatgagctgaacgccgcttataccgcggacggttatgcgcgcatgtcgggcgctggagcgctactcaccacctttggcgtgggagaacttagcgctattaacggtatcgcgggcagttacgcggaatatgtcccggtcttgcatatcgtcggcgcgccctgtagcgctgcgcagcagcgtggcgaattgatgcaccataccctcggtgacggcgattttcgtcatttttatcgcatgagtcaggcgatatccgctgccagcgcaatattggatgaacagaacgcctgtttcgagattgaccgcgtattgggtgaaatgcttgccgcacgcaggccaggatacatcatgctgcccgccgacgtggcgaaaaaaacggctatcccgcctacggaggcgctggcgttgcccgtgcatgaagcgcaaagcggcgtggagacggcttttcgttaccacgcccgtcagtgcctgatgaacagtcggcgcattgcgctattggccgactttcttgccgggcgttttggtttacgaccactgttgcagcgctggatggcggaaacgcccatcgctcatgcgacactactgatggggaaggggctttttgatgaacagcacccgaacttcgttggcacctatagtgcaggcgccagcagcaaagaagtacgtcaggccatagaggacgccgatagggttatctgcgtcggcacccgttttgtcgatacccttacggccggatttacccaacaattgccggcggaacgcacgctggagattcagccttacgcgtcgcgcatcggcgaaacctggttcaacctcccgatggcgcaggcagtgtctacgctgcgcgaactgtgccttgaatgcgcttttgcgccgccgccgacgcgttccgccggacagccagtgcggattgataagggagaactgacccaggaaagcttctggcaaaccttacagcagtgtctcaaacccggcgatattatccttgtcgaccaggggaccgccgcctttggcgctgccgcgctgtcgcttcctgacggcgcggaagttgtggttcagccgctgtgggggtctatcggctattccttgcccgccgcgtttggcgcgcaaaccgcctgccccgatcggcgggtaattctgattattggcgatggcgcggcgcagctcacgattcaggagatgggctcgatgttacgcgacgggcaggcgccggtcatcctgctgctcaacaatgacggctataccgtagagcgcgccattcacggcgcggcccagcggtataacgacatcgcgagctggaactggacgcagataccaccggcgctaaacgcggcgcaacaggcggagtgctggcgggtgacgcaggctatccaactggcagaggtcctcgaacggttggcgcgcccacaacgtctgtcatttattgaagtgatgttgccaaaagccgatctgccggaattactgcgtaccgtgacccgggcgctggaagcccgcaacgggggataatggcccccgctgcgccggattagggttcgtgacggttggcggccagcaacggttttcccgccagcaatagccaggcggggagcatcacaatgcagagcagcggcagcagattggtatccggtacgacgactgccgccataaacagactgagccagccgtcgcgcgtcactaccagcactaagccaagaatcgcgcaggagacggtaatcgccgcgggtacggcctcaacatgggcatggagcatgagccccagcgccgcgccgataaacacagccggaaaaatgcgcccgccgcgaaagccgctcgccgccgcgatgaccagcgcggcgagtttgacgacggctaaggtaaaataatctcccgcgcccaacgtctggctaaacgccatttgttgcatttcgtccaggcctttaaacagggtaagcggcccgccaatgacgcccagaatacccagtataaaaccgccaatgccgagaatcaggaccggattttttagtcggtgcagcaactcgtgcagacgcggaaggcaccagacggcgaccatcccggcggcaatggcgatcgccgcgacgatcgctccgctggcaatgtccaccagccgcatctgcgtgtaatgggcgatgggtaacgaaaaatgcggatgaaagaacaggctggtggtgagtgaccccgccgctgccgccattaacggcgcaaacaggcgatcccacatgggaatatcgttagagccgctaagcgtttgcgaaaaaatcagcgccgcggcgacgggcgtgccgaacagcgcgccgatggtgcctgctgaggccagaatcgtccagtctaacgccgtgatacgcggaaacaggcgggagccgaaagccgccgccagcgcgatatttattgtcattatcggatgctctggccccaaacttaccccaccagcaaggccgatgattaaggcgagaagcagcccgggcagcgcagatggcgagaccggcatactgattaacggttcgatggccggatcggggccagcgtgtccgggactgtaacggataatcaaacccaccacgatcccggttagcgtgagcatacccactatccagaacggcgaatcataagcgattccgatgctggcgggcagtcgttgccaaagaaattgctgaaaaaccgacgcgactttcatcgaggcgattaaaactaggcttgacgctacgccaataatcagcgcagggagcgacagcagcagcatcgttcgggcacgcgggtggaacataatctcttccttacacggggtcgtatatctattttgcacagcctgcccgacggcattgctgcaattggtgctgaaacaagaaagtaattctgtgatgaagatctatatttataggcagtcagcctgatggccgttgttgttatgcccccatgaatttacagtgtgacaaagacttattttgactttagcggagtagtagaagaatgacaaagtatgctttagtaggagatgtaggcggcacgaatgcgcgtcttgccctgtgtgatatcgccagtggagaaatctcgcaggccaaaacgtattccggcctggattaccccagtcttgaggccgtggtgcgcgtttatctcgatgagcatggcgtcagcgtggaagatggttgtatcgccatagcctgcccgattaccggcgactgggtggcgatgactaaccatacctgggctttttctattgcggaaatgaaaaaaaatctcggctttagtcatctggaaatcatcaacgatttcaccgccgtgtcgatggcgatcccgatgctgaaaaaagagcatttaattcagttcggcggcggcgaaccggtagacggcaaacctattgcggtgtacggcgcgggaaccggcttgggcgtggcgcatctggtgcatgtggataagcgttggattagccttccgggcgaaggcgggcatgtcgattttgcgcctaatagcgaagaagaagctatgattctggaaatattgcgcgccgaaattggccacgtttccgccgagcgcgtgctgtctggcccggggctggtgaatctttaccgggcgattgttaagtccgacaaccgtctgccggaaaatctgcgcccgaaagatattaccgaacgcgccctggcggatagctgtatcgattgtcgccgcgcgttgtcgctcttttgcgtcatcatggggcgatttggcggcgatctggcgttaaccatggggacatttggcggcgtttatatcgctggcggcattgtcccgcgcttcctggaattctttaaagcgtctggcttccgtgggggctttgaagataaaggccgctttaaagattatgtacacggtattccggtctatctgattgtccatgataatcccggcttgttaggctccggcgcgcatctgcgccagacattaggccatattctataagtcagacggcggcataaacgccttatccggcctacaaaagtgtgtcatctgtaggcctgataagcgcagcgtcatcaggcaatgaaacattctcttgtcagtctcaaaccgcgtgcctcacgcggttttttttcattgccgttcctgtgtatgaatacttcaactgactgaattatttcactttactcttgctgagcgaaaagtcaaacaccagcgcgttgagtcatcacgtcatggtgattactcaggcgaaaacagggatttattttactgtacgtatccggttcgctgccttatttacgctttcatcgcggcagcttgccggaaaggatccttattttcggggaaatatccctgaaaaataccgcaatatgacatgaacgaataccattatcgttagtaaggcttttgattaaagaggaaaaaccacaaaatcaaaaggggattatttgagataaggtttattgacaggaaattatcgtcggccataccgcgttaggtaaattcaatgatatcaatttgttaatgatgtgatttatttggtgctataactgacacgcttaaaaagtaaatttttacggttgttcctctttttcgtcgctaaaaaatattttcattagcctctcgacaggaagaaaattttcaggctattttctaaaggagccaccatcgtggcagcgtcgctcggacggtccgggcgctaacgttaatctgaggatattatggctgactcccgccctgaacgtcgctttacgcgtatcgatcgccttccgccctatgtttttaacatcaccgctgaactcaaaatggctgcgcgtcggcgcggcgaagatattattgatttcagtatgggtaatcctgatggcgcaacccctccccacattgtcgaaaaactttgcaccgtcgcgcagcgtccggatacgcacggttattccacgtcccgcggcataccgcgtttacgccgcgcgatttctcactggtatcaggaacgttatgatgtcgatatcgatccggaaaccgaagcgattgtgaccatcggttccaaagagggactggcgcatttaatgctggcgacgctggatcatggcgatacggttctggtgccgaaccccagttacccgattcatatctatggcgccgttatcgccggggcgcaggtgcgttcggttccattggtagagggggtggatttcttcaacgagctggagcgcgctattcgcgaaagttatccgaaaccgaaaatgatgattttgggttttccgtctaaccctacggcccagtgcgtcgaactggaattttttgaaaaagtggtcgctctggctaaacgttatgatgtgctggtggtgcacgatctggcgtatgccgatatcgtgtacgacggctggaaagcgccatccattatgcaggtgcccggcgcgcgcgacgtggcggtcgaatttttcacactgtcgaaaagctataatatggcgggctggcgtattgggtttatggtgggcaataaaaccctggtcagcgcgctggcgcgcattaaaagttatcacgattatggtgcttttaccccgcttcaggtggcggctatcgccgctctggaaggcgatcagcagtgcgtgcgcgatatcgccgagcagtataagcgtcgtcgcgatgtgctggtgaagggactgcatgaggcgggctggatggttgaaatgccgaaagcctcaatgtacgtctgggcgaaaatcccggagcaatatgcggcgatgggatcgcttgagtttgccaagaagctgctgaatgaggcgaaggtttgcgtttctccagggataggctttggtgactatggcgacacccatgtacgctttgcattaatagagaatcgcgatcgcattcgccaggccgtcagagggattaaaacgatgttccgcgccgatggcgtgctgccgtcacatccaaaacccgttgaagcgagcacggagtagaaaagcaaacaggagccccatggctcctgttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttatttgcattgtacttttaaatcatcagggcgaaagtaccggcccaaacgatgaccataaatgaaatgcccataaagaaatatttcacgtttcatctctccgcgtacctgtcgtacgcctaaatgaacttacacttacctgattatagagagttgatgccggataatacgaaattgagaattattcgtgtttcgaccgcctgcatcacctcagaattctgcgcgtcatcgctccagacggcgctaatgtacgcctaaaaatgaggtgaaacaagaggcattttcttatttatttttagtaacttacaagtgtcgtgaatcggcgacagtttaatttctgacagtgatgaatcgctattgagcgacgccgccgacacagtaaaaaaacgcctgtaaacaggagacttatcgctaaaagcaggaatgagtaatttacgatgtgaatattatggcaatgcgaaatgacaaaataaaaggccttgcggcctttttcagatgtagagtgacgcttcccccaacgggcgagtcttgaaacggcgatgaatccagagatattgctccggggcgcgcatgatctctttctcaataattttattcatataggcagcggcttgattttcatctgccgggtaaccttccatttcaggggtaatatacagacgataacccgagttatcggatttccttaccattgtaacggtcagcatggcggcgccagacagcctggacagtacataggtaccgttggtggtggcgacgttttcaaccgcgaaaaatggcgcaaaggagctgcctttaggaccgtagtcctggtcgggagcaaaccaaacggcttcccctttttttagcgcgcccacaatgccgcgcagattgtttctgccgatcatcgctttatttgagcgcatacgaccgcgcgtctgcacccactccatgagcggattgttatgcggacgataggtcgccatcatcggctggcagagacccattacccggcctcccaattccagcgacataaaatgcacgccaacgaccattacgccgcgattttgcgcctgcgcacgggtaaggttgtccagcccgtccacatcaaaccatttgcgaacccggctatcaggccagaaccaggccatgcccgtttcaagcagcgccatgccaagagagtggaaattctcggcgatcagtttttccctttcttcccgggagagggtcggaaaacagagttcaatgtttttctgagcgatcgactcacgtcgcttcaggaaggggcgcgccagcttaccggtgcgggtgcccagaaaacgcaaaaccgggtagggaagctgcaccagtaaccagaggacgccaacgccaaaccacgtcagccagtagcgcgggtgcaaaaacgcgcgtgaaaatttgctttgaggaaacataaaataccttctgtagatacgaaaataatgtatcgcagaagagtcattatccgcagcggtacactctgaaatacgcatcatccttcaagttgcgttcgcttatccgaagcacttacttgagtaagctcatcagggtaacttgaatgatttgcgtatagttaggccatcatgtacgacaatggttcccgtaaggagtgtaaaactaagtcagtactaaaccacgagggcatgaacgccaggcaggctaatgtaccaccagttatttactcgcgcccagaaattctttatcaagaagcgtaaatatttctcccgtagcaaaaataagctaatcattatttttaatgcattgtttttacagtgataattttatttcagacgaaggttattgaaaaatgattagaaaataaaatgtgagataaatgttatggaaatgacgtgctgataaggtttatcttaaaggagaagtgagagggaccgtaaggctatatggaagccttgccatagacaggaggtattatagatgatctatttatggacatttcttgcaataagtatacttgccgtgagtggctatatcggtcaggtgatgggggctttttctgcggtttcttcttttacgggaatggttatccttgccgcgctgatttatttactcaatgtatggctgcaggatggcgatgacatcgttagcggattattgctttttctcgcaccggcatgtgggttaattattcgctttatggtgggatacggtaagcgttagtcagtacatacctttcatacttcaagtggcttatgtgttggctatggattactcggcccattcatgggcctcgccctgacgggacgtcgctcaccccagtcacatcgttatctatgctcccggggactcactcccttgccgcttttaagcaactcgaattatttttggtatacacgatgtcagcgaatagatagcgccgacaatgtcggcgcttctgttccccgggaaggctaatcgtttattgcgcgtccgcaagctgcagtgagtcctgattatgtaacgcattctggcgctggcgttccagttccagcgcgccgcgatgggagaggtaacagaatagaatgcagcacacgatgccgcccatcagaagataaaatccgccgtaccagcccagtttatccaccatgacgccaaacaggctggtgcccaacgaggcgccgaaaatatagctcatgaacccacgtaaaccgacggcggaacctacggcaaagctggggactatctccattgtctgtacggacgcgaggaattgcgggacgtaaatcagacaacctacaatggcggcgaaaatcgttaccatcagcaaagattcacttttccagtatccgatcagacagacaaaaatcagcgccatgcaaatcatggctaacggcattctgcggcccttaaacagtttatctgacagccagcctgccagtagcgtagagggaattgccgcccactcgaaaaagagaaacgcgacgctcatctgttcttttgaaaagtgttttactgtcaacagatagataggcaaccagctaatcatgccaaaccgcaccatatagacgaagacatcgaccagcgaaatataccaggcatttttattgcgcagcacataagtacagaagatttgccatgcgctcatattttccggcgcttttgccgtattcttcgttttcagtatgactttttcttccggcatcatctgttccagggagggaagaccttcttcgcgcggcgaaccttttcccaagaccagaacaattaaggcaaaaatgacggcgacgcaggccggaacgatataactggcgctttgccagtgttcgctgcccaatatcgcaaaagccgcaccgacgataggcgcgacgatcccgccgccaacgttatgcgagatattccagaaggcgcctacgcgtccgcgttcccgacgagggaaccagtttgcaatagtaataaacgaggggccgacgcccatgccctgaaaaaggccattgaagaccaccagagcggcaaatatccagaatgcgctactgaatcccagcccaacgttaacaatcacgcagagtaccagaccgcacgccatgaagacttttgggctggctttatccgccagactgctcattacgcctttactgattccgtaagcaataagcatacagctactcagcaggccgatttgcgtagcgctgagatccaattgctcttttaaataaggcgtcgataatgtgaagttgtttctgactatatagtaagcgagatatcccagaaatacgcttaacaatgcctgtatacgatatcgaccatacgtagcctggactttttccggtgggactttatgcgccgatcgccctgtttttaatattgttaacatggagtcacctgtattttatagtgagatgaacatcaggaggttttgtcggtagagtgaaaggagtgacaataaaattcaagtcgaggaaatgtgtcaaaattgactcaattgggtgaatttaaaggttatttttgacccatcctgaagggtgtggtgaaactttaattattggcatggccgttttatcgttagcatgtgcggatattaacaaatttgctgccagtgatctgatacgctttattgatgttttcgggcgacggacccgttattattcaaataacgttgttctggatgccaacagaaataaaagggtaagttttgtctcaatattttctttatgtgatatcgatatttatgaacgggatcacaaatcgacttttctcatactgtggttgtttcgccagagtgggcgcttttacgctatggctggcggcgatgttcggttcttgccaggcgtacagccgcgagctggtgatggcaacgaccttttcacccagcgcgaccgcctggattatccagcgctggcagacggagccgggttccgtcatgattcgtacgctcaaccgtaccagcggttctttagagcaattacttgatacggcgaatgcggaaaatgtcgatctgatcctgacgtcatcccccatgctgttgcaacaccttcaggagcaccaaaagctggcgctattggatagcgcgcctgccgccagccagaagctggtgccgcgttctatccgctcaacttcagtggcggtagcggtatccggatttgggctattgatcaaccgttcagcgctcgctgcgcgccatcttccgccgcctgccgactggcaggatatgggcctgcccagttaccagggcgctctattaatgagcagtccgtcacgctcagacaccaatcatttgatggtggagtcgctgttgcagcaaaaaggctggacggcagggtgggcgacgctgctggcaatctcgggtaatttggtcacgatttcctctcgcagtttcggcgtagcggataaaatcaaaagcgggcttggcgttgccgggccggtcattgataactatgctaatttgctactcaacgatcctaatcttgcttttacctattttccgtattctgcggtgtcgcccacttacgtcgcggtgttgaaaaacagccgtcatgcagacgaagcgcgtgcttttattcattacttattaagtccgaaagggcaaaggatactggctgacgcgaataccggtaagtatcccgtcgcaccgcttagcgccgataatcctcgcgccgcgcaacaacagcgtttgatggcccagccgccgttgaactatcgtctgatcctgaagcgtcagcaactggtacaacgcatgtttgataccgcgatcagttttcgtcttgcgcagcttaaagatgcatggcgagcgttgcacagcgcagaaacgcggcttaaacgccccttacctgaaatcagagccttattgaccagcgtcccggtggatgcggcaagcagcgaagatgaaacctggctggcgcagtttgataataaaagctttgccgaacaaaaaatgatggagtggcagatctggtttctgaacaatcagcggctggcgattcacaaactggaagagctgaaatgaaggggagattattgcaacggcttcgtcagctcagtatcagcaacagtttacggggtgcatttttaacgggcgcattactgacgctgattgtcagtatggtcagcctttattcctggcatgagcaaagttcgcaggttcgctattcgcttgatgaatattttcctcgcatccactccgcttttttaattgaggggaacctgaatctggccgtggatcaactcaatgaatttttgctggcgccgaacacgacggtacgtttgcagttacgtacgcagattattcagcatctggataagattgagcgtctcagtcaggggcttcagcttgctgagcgccggcaactggccgtcattttacaggatagccggaccttgctggcggagctggacaacgccctctacaacatgtttttggtgcgggagaaagttagtgagctttccgctcgcatcgactggctccatgatgatttcaccacggagctaaattcgctggtacaggattttacctggcagcaagggacgctgctcgatcaaattgaggcgaatcagggcgacgcggctcagtacttgcaacgttcgcgcgaggtgcagaacgagcagcagcaggtatataccctggcgcgaattgaaaatcagattgttgatgacctgcgcgacagattgaatgagctcaagtccggcaataatgacgggatgctggtggagacccatattcgctatctggaaaacctaaaaaaaacggcggatgagaatattcgtgcgctcgatgactggcccagtacgatcacgctgcggcaaaccatcgacgaactattggaaatcgggatggtaaaaaataagatgcccgataccatgcgcgattatgttgcggcgcaaaaagccttactggacgccagccgcgccagagaggctacgctagggcgctttcgcacgctgcttgaggcgcagttaggtagtagtcaccagcaaatgcagacgttcaatcaacgcctggaacagattgttcgcgttagcggcgggcttattttagtgacgacgctcctggcgttgctactggcctggggactcaaccactattttatccgttcccgactggtgaagcgttttaccgcgcttaatcaggctgtggtacagatagggctggggagaaccgactcgactatcccggtttacgggcgcgatgagctaggacggatagcccgcttgctacgtcatacgctgggccagctcaatatgcaacgcaggcagcttgaacaagaggtcgccgagcgcaaagagatagaagccgacctgcgcgccatgcaggatgagttgattcagacggcgaaactggcggtagtcggccagaccatgaccacgctggcgcatgaaattaaccagccgctgaatgcgctttcaatgtatttatttacggcgggacgcgcgattgaacaaggtcagagcggacaggcgagaaatacgctcaccaaagcggaagggctcattaaccggattgacgccattatccgttcgctgcggcagtttacccgtcgggcggagctggaaacgccattgtatcccgttgatctgcgccaaaccttcgtggcggcatgggagttattagccatgcgccaccaatcccggcagggagcgctttcactgccaaccgacaccgtatgggttagcggcgatgaagtgcgtattcagcaggttctggtgaatgtgctggcgaatgcgcttgacgcctgttcgcatgatgcggcgatcgcggtgacatggcagacgcagggagaggcgctggaggtttatattgcagataacggccctggctggcctggggcgctgttgccctctttactcaagccgtttaccaccagtaaagctgtcgggttgggtattgggctgtcgattagcgtgtcgctgatggcgcaaatgaagggcgacctgcgtctggcgtcgacgctgacgcgtaatgcttgcgtggtgctgcaattctcggtaacggatgtcgatgatgttgaatgatgaatgttctattttgctgattgatgatgacgttgatgtacttgacgcctatacccaaatgcttgagcaggcaggctaccgcgtgcgtggctttacccatcctttcgaggccaaagagtgggtaaaagcggattgggaggggatcgttttgagcgatgtgtgtatgccggggtgttccggtatcgatcttatgacgctgtttcatcaggatgacgatcaactgccaatcttattgattaccggacatggcgatgtaccgatggcggttgatgcggtgaaaaagggcgcctgggattttctgcaaaaacccgtcgatccgggcaaactgttgatattaattgaagacgcgctacgccagcgccggtcggttattgcacggcggcaatattgccagcagacgttacaggttgacctgattgggcgcagcgagtggatgaatcagtttcgacaacggttacaacaactggcggaaacggacattgccgtatggttttacggtgagcatgacacaggacgtatgactggcgcccgttatctccatcagctggggcgtaacgcgaaagggccgtttgttcgctatgaactcacgccggagaatgccgggcagttggagacattcatcgaccaggcgcaaggaggcacgctggtgttgagttatcccgaatatctgacacgcgaacagcagcaccatctggcgcgtttacaaagcctggagcatcggccttttcgtttggtgggcgttggcagcgcttcgctggtggagcaggcggcagctaaccagatagcggccgagctttactactgtttcgccatgacccaaatcgcctgccagtctctttctcagcgaccggatgatatcgagccgttatttcgccattatcttcgaaaagcctgcctgcgactcaatcatccagtgccggaaatagcgggggaattactgaaaggaataatgcgacgcgcctggccaagcaatgtgcgcgaactggccaatgcggcggagctttttgctgtcggcgtgctgccgctggcggaaacggtcaacccgcagttgcttctgcaggagccgaccccgcttgaccggcgcgttgaagagtatgagcgacaaattattaccgaagcattaaatattcatcagggacgaattaatgaagtggcggagtacttgcaaattccccgtaaaaaactttatctgcgcatgaaaaaatatggtctaagtaaagagcattataaattctgatattacagttactttcaatctggctgacaacaacagcaacgatgtcgttagccagataacgtcgcattaccgtaatggtaaatcattccattatgattatagattgcttattattcacctgagcatcaaattctatttcttaacttcaatataaggtaaaaatgcgtcaagttctctggcgtaataaatgtactcttgtccgacgatttgacaagatgaaaacttcatcacctctccagattacatctgaatatgaggacaagagaaatgaaaaaacatgctattgcagtaatgatgatcgccgtattttctgagtcggtttatgcggagtctaccttatttattccggacgtctctcctgagagcgtcacgacatccctttctgtgggggtgttaaacggtaaatccagggagctggtttatgataccgacaccggacggaagctgagtcaactggactggaaaataaaaaatgtcgccacgttgcagggggatttatcatgggaaccctattcgttcatgacgctggacgcccgcggctggacgtctttggcgtcgggatcgggtcatatggttgaccatgactggatgagcagtgagcagccaggctggaccgatcgttcaattcatccggacaccagcgccaactatgctaatgaatacgatttgaacgtgaaaggttggttattgcagggagataactacaaggcgggcgtaacagcgggctatcaggaaactcgttttagctggacggcaagaggcgggtcttatatttatgataatggtcgatatattggtaactttcctcatggcgtgcgcggtataggttatagccagcgtttcgaaatgccctatatcgggctggcgggtgattatcgtattaatgactttgagtgtaatgtactgtttaaatacagcgactgggtaaatgcgcatgataatgacgaacactacatgcgaaaacttaccttccgtgaaaaaacggaaaattcacgatattatggcgcgtctattgacgccggatattatattaccagtaatgcaaaaatctttgctgagttcgcttacagtaaatatgaagaaggtaagggcggtacgcaaatcatagataaaaccagcggtaatacggcgtattttggtggcgatgccgcaggtatagctaataataactatacggttaccgcggggttgcagtaccgcttctagaccacatcgggatgtcatcggtcataaccggccgatgacgactttttgctgaacgtgtggcatgcccggtgatattgtgtttacctcatatagatctggcgagtttggcgttaagacgtggcaaggaacagtagagggggacctcatccagatgttataaacttcaattcagaaagttactttccatatactctttgtgggactgcttcaacctttgggcagatatcggaaatgaaaaagatagaccaggcgactattcgctatcagaatatccggtacaccaactaccaacaaatcatttagtcgatggtctcgttgccattggttcatagagtgttggtcttggtatggatggctggggaagttatgtatcgaacattcttatgcaagattgcgcagggtctggtggtctatggtacacatatgggaagacattcacatatatttctgtaatcgatactaaaactttaacactaactaattgtttgtagaaagtggttgcattattaatggtttgagactcattgacataaaacaaacaccatctggtaatctgtcagaccccgcatcctcaacagttaactataaagattgtatggtagctgagatgtcattagtcctaatatcgtgtcagataaatttataaaagattactcatgttttgtgtcacatgcaaaaataattcggcttcgttaaggtctttaggggaaatacctaatggataattagttagattaacgttaacaacactttgaacgtgtaatgaatatgggggtataatataagtattgggagattgtaattaaaaattatgtaattatctgattattatatattcactccagcaaaggagaaaggcaattatggacgaaaagaaactcacagctcttgcggctgaactggctaaaggtcttaaaactgaagccgacctcagtcagtttttccatatgctgacgaaattaaccgtcgaaacggcgctcaatgctgagctggctgaccatctcgggcatgagaaaaatgctcctaaaacgagctcaaactcccacaatggctactcattaaaaacggtgctgtatgatggcggcgagatagtgctgaacatgctgcgtggccgtgaaaatacctttgaactgtagctgattaaggagcatcagacgcgtattacgagatggaaagtcagatttatccctttatgccaaaggcatgacatgactacccgcgaaatcatcgccaccttcaaagagatgtacgacgctgatgtgtcgcccatgctgatacttaagatcaccgccgcagtaaaagagttggtcaaaggggcgtcaaaaaatggagtatgccgatccaggactggtcgctggcaatgattcgctttattatcgagttcggtgaccgcctgagcgatcaccgttaatatagtggcagttacacagtatgactggcatgttccatattggatttatatgtaatagtaacagcctatctatttgattattttatttccaattttattaaaaaggaaatcagaaccaggctttgttaaatgtccccaatcaacggcagtgataaaatcaggaccattaccaactcttgtaagacatccactttcgttacataatgctttgtatgctgatatatattcaattcccatttttggaacattgttactaaagtaagagtcccactcgcttatttcactatttaatccatatgtcatatacaatggtggagtttttttaaactcactcaggtagttagatattattttaactaaatttgcattccattccgggactggtccaatgaaaacaatccttgagtcaggggatgcctctttaatttttttaatggttaatgataacgcatcaattgctaactttttatcatgtactccatttgttcctcgaactgaccatgtcagcagaaccacctcaggctgaacacgtttaatttcattaattctattattgtttagagtgatgacacttctctgtaaatcatctttaccgtcaacaaatagaggaggagcattaccatctgtcatttggcttattatataatcagaacctttattatctatataatgagaaagcccattgaaaagagccgccgcataagaatcaccaatgataaatatattatgcttgccattttttatacatccattggatatggcagcagtaagttgtactgagtgacatatccctccacggagtagttctccatatttataataattgtacacgtcagtaacagaagcatattcacttgctgatttattgatttccctgtctttaactccatttatatgaaaaataaatgcgccaattaaacccgtcccaaatacagataatgctaataatattgctgtgatatatttacttctggaatttctcagtggtttttcaattaaataataagttaatatcgccaaaaagaacgataataataaaagaagagttaattcatggtagtctggtgagccagcaaatattgaacgatagaatgaataaataggccaatgccacaaataaagaggatagctaataagaccaaagaaaacaacaggcctaacactaagcaatttcgacacaactaaatcattaccattagatgctattataagagaggcgccaagtattgggattattgctatatatccaggaaatgacatcttttcatctatcatggttattgataatgcgattagtataattcctaacagggacattaattttgataacgaagtgtttattcctataaatctcaatgtggatataatcgctccagccattaactcccaaaatcttgatgcgggagagtagtaattagctccgccatcagatgccattgtaaaaatgctaatcgcatagctaattataaatatagttgcgcatgataatactatgtttctgttatggtttttgcttctaaagcatagcaatataactactggccatattatataaaattgctcttcaattcccagcgaccacaaatgtagtaaaggtttaaggtatgattttgaatcaaaatagccagactcactccaaagagtaaagtttgatataaagaatgagccactaaaaacatgcttaccaagtaatttgtaatcatcctggaataaataaatccaaccaacaataagacatgatacaagaactatggataatgctggaaatattctaagcactctccttttatagaaatcaaggtatgaaaatgatttgtttgatgcagattttaatattattgatgttataaggtatccagatatcacaaagaatatatctactccaacaaacccacccggcaataatgatgggaaataatggaatattaccacagataaaaccgctattgcgcgtaatccatctatatcaggtctgtattttaagtgttccaacttaaattacctcaatttaaaaaaagattaataaaatggttgtgcatcttgcatcattcccgaagtttcgtgtaaacgaaaacggaatgacgagtggatcagatacggctattattttaattattgactccgtcacatctttacttccgtcattaataaaaataatctcaactttatatttttcaagttcattaaactcatgtaccgttctatagaaaatcggtatcgtgtcttcttcgttaaaaaccaggacgacaagagagattttcatttttatccctgaagataatgaatctggaatagataaagccgcataccaggctaattgccgagaaagtgatgagggtaaccaatggtggcaaagaacattggtcagccatccatccaacaacagcgctcagtgttcccatgaatcccatatacatcatgtagagaattgcagtagtgctggcattaaaggtgaagcgcgcattggcatagaagctgaacgatacagcgataacaaaatcggaaaagttcgtcagcgcctgatgcgtatgcatcccatacatacagaaagcaaatactccccaatgaatgagcgtgttaagaacaccgatcgatgtgtacttagcgaataacttcaacattatgaaaattagccgattcagaaaggtctggagtgtagcactacaaattggtttgatcgatataagcgatcaataattgtatttttaatagttttaagctattgagttttaatatattgatcgatgttatcgatcaattggtattgctgattgccaagcgtcttggaataaaaacgggacatgtaaagctttacatcgtcttacaaggctttgcatgttttttcagagagaggtacttgaaagggtggaagtgctggggagagggggagcgttaaaaattctgtataattttagtaacataaaataaaaaagaatggcacatgtcccatcccttcgatttcgacaaagcacttaaagcccttcaggtccggccaggcattaacgggcaaagatggcatcttaacgccattaatcaagtatttaaccgactctaccctgtctgctgaacttgattcccatctggctcaggatgttgaggcaaaccgtaaaaatggttccggcaaaaagccattaaagccccaacaggcagttttgaactggcaactccgcgcaatcgtaacggcacttttgagccataattggtgaagaagcttcagaccccctgtacgacgagatcgagcgcaatatcattcgactgtttgcgctggagatgagttatcaggacatcggccgggagagtgaagatctttatgccttcagcgtttcaaccgccaccgtcagtgcagtaccgataaagtcatccctgaactaaaacagtggcaacagagcccgctggagaaggtttatcccgtcgtctggctggacgctattcattataaaaaccgtgaggatggccgttatcagagcaaggcggtttataccgttctggcactgaatctagaaggcaaaaaagaagttctgggcctatatctgtcggaaagtgaaggtgctaacttttggttaagttctaacagcgagaggggactttaaagggatgcttttcgttatgtttataggcactattcgctggagatcataagacatcaaaaacgctgcaacgccttgtgtggtgtgggtttgctgagattcgtgagaggtgggtaaaagaggtcatggtgtcccctgcaggaatcgaacctgcaactagcccttaggaggggctcgttatatccatttaactaaggggacaacgcggcgccagtatagcgttttttattcgccggagtaagtgtagcgccgcctgactggttaaaccgtcgccactcagcgctgtttttccgcttttttccgctcccgttccaggcgctcgccgcgtagcctcgcttcttccttacgcttattgctcatatcgttgcggatctgcgcgtggctcatcaatgcgaaaataaaggtgccgccgcagatatttccggcaagtgtgggaagggcgaagggccagaaaaagtcgctccagggcagcgtgccgttgaaaaccaaatacaaaatttcaacggaaccgacgacaatatgggtggtatcgcccagcgcgataagccaggtcatcaaaataatgaccacaatttttgccccgcctgcagcaggaaacatccataccattgtggcgatgatccagccagagataatcgcgttggcaaacatctccgttgggctatttttcatgacctccataccaattttgacaaaggcatcgcgggtctcttcatcaaatataggcatatattcaaaagcccacgccgcaaccccggtgccaataaggttgcccaataagactacgccccataagcgcatcagcaggccaacgttactcagcgtgggattttgcattaccggcaatacggcggtaacggtattttcagtaaataattgctggcgggccatgatgacaatgataaaaccaaaggtataaccgagattttccagtaaaaagccgccgggaacgccttcaagctgcacgtggaaaatccctttcgccaggagtgatgcccccatagaaagtcctgcggcaatggctgaccagagcaaagccatcgcatcgcgttccatctctttttcaccatcctggcgaatatgttcatgaatcgccatggcgcgggaaggaagacgatcttcatctacttcaatctctttaccgctttgtttttcttcgctttcaacttccaggtcactgctgtgccggttaattttatcgtcgttaaggctatccatgatgatccttgctgattaacacatattaataaagcgtagcggtttttcatttacccaggccggggcattctccgaaaaaataaaaataatcacgctcgtttttatctgtttcgttagaatagggccgtcatgttgttgcgttaccaggctatgctcagagcaatgagatcgcgcatatagacatcgtttgacgtgctgttaaaatcgctcacacctaaacaggcggatacggtagcgttccgtcatggatggcaatcagcgatagccataattcacagggagacatctatgaagcttcgcctgtcggcgctggcgctgggaaccacactgctggtcgggtgtgcgagttccggtacagaacagcaggggcgttcagacccatttgaagggtttaaccgcaccatgtacaacttcaactttaatgtgctggacccgtatgttgttcggccggtcgcggtcgcctggcgtgattatgttccacagcctgcgcgtaacggtttaagtaatttcaccggcaacctcgaagaaccggcgatcatggtgaactatttcctgcagggcgatccttatcagggtatggtgcatttcacccgtttcttcctgaataccttattagggatgggcggctttattgacgtcgcgggaatggcgaatcctaagctgcagcgcgttgaaccgcatcgctttggcagtacactgggccattatggcgtggggtatgggccttatatgcaacttccgttctacggcagcttcacgctgcgtgaagatggcggggatatggcggataccttgtatccggtgctctcgtggttgacctggccaatgtccataggaaaatggactatcgaagggatagaaacccgcgcgcagttgctggactccgatggtttgctgcgccagtcttccgatccttatattatggtgcgcgaggcatacttccagcgtcatgactttatcgccaatggcggaaaactcaagccgcaggaaaacccgaacgcgcaagcgattcaggacgaactcaaagagatcgactcggaataaacggcagtaaataaaaaggtgagcgcaatgctcacctttttgatccgtttcagaaagagattagaacgcgtagttaaagttagtaccgaacagccaggctttcccttcagattcaaactgataagggccttcattaattttcacgctctgaccatgcatataagagacgccaacgtcgacagacgcatctttgttaaaggcgtaagtcgtaccggcgctcagccagaaacggtcctgatccggaatagagatagaacggttttgcgctggtaccgggctgtcatcgaaggcgataccggtacggaacgtccagttgtcatcgtagtaataggtggtacccaacgcaatgcgataagcgtctttaaagccttcatgcttctcaaagagcgtatcgccggcggtcgattttgccttcaattcctggaactgactccagctggtataggccaggctatagtggatggcccactgtggcgccacacggttataaccggacacttcccacatttccggcagattcagcgtcaggtagcctgactgcgtcgcgccgccggttgccgttgggataggcaggttaaatcggtttatagcgatgggaagatcgctactgtagttgcctttaaagtcaattttgacttccgagcggtaggtcagcgcgtagcggttatttttatccagttcataaaggataccggcattccagccaaagccccactgattaccgttcaggtgggcaatcttggtgtcgctgagaatctgacccgcgaccggcgccagcgccggattctgtgccgcgaccaactggcctaaatcgcccgcaaaacgttcgattttcgcgcgcgcgtataccgcatcaaagccgaggccgaagctccaggcctcatttaagcgataagcgccgcttaaattcaggttcatggtttcaagatcggtcgtaccgccaaccgagccgccggcgtatgtgtcgttaaactctgtcgccagaccatagttagaggtaatagaagccccccagccaaactggtcgttaatcggggcgacaaaatggacgttcggcacccaggccgttggcgcgatgttatccgcatctaacgtccgacgagatggcgatgtcccgctaatattaacatcaggatcaatataaactgcgcccgctgaaaacgtcgggcggtcaaacatggtaattaacgccgggttgcggctaacgttacccgcatcatctgcgattgcgccttcacccgaataggcccggccaaggccagaggaagaaaattcgtttaactgaaagcccgcagaccaggcctgggtggagatgattgccactgcgactgcgagagcagactttgtaaacagggttttctggctcatgaccataacctcattgattatttttatacaaactatgttacatgctgtaacaggagcgcgaagtgtagggtctgcggtacgacttagaaatcagaccagtggcgagagtataggtctgaccagctagaatgttgcaagtatgtttataagttttttcaattgtgatcttagaaacgagatctggctggtaaaatcggcgggcttaacggtcacccgatcgcgtgatttttgttttagatcatttttaagtgtgatttcggtcacttaacgcgtttcccaccattaacgactggagaggcgaatgccgggagcgtaaaatatccccatcgtttatctggcaccctgggtgcaaatacagaggaaatctacaatgagtaaatgcagtgctgatgaaaccccggtttgctgctgtatggacgttggaaccatcatggacaactccgattgcaccgcgtcatacagccgcgtattcgctacccgcgcagaggctgaagagacgctggcggcgttaaccgaaaaagcgcgtagcgtggagtctgaaccttgccaaattacgccaacctttaccgaggaatccgaaggcgttcgtctggatattgattttgttttcgcctgcgaagcagaaacgctgatcttccagctcggcctgcgttaatccgttcattcacgacgcctccgtcatcatctggcggaggcgttttctttttttgtcgtttcccttcactgtgccttagctcccactttcttttctctctgcttggctaaatgtaaaaaattggttaagactgtgatcaggtcagaccactaatttatttttttacaggggagtactatgcgtcaggctttaccgttggtcacccgtcagggcgatcgcattgctattgtcagtgggttacgaacccccttcgctcgtcaggccactgcatttcatggtattcccgctgttgatctcggcaagatggtggtaggcgagctgctggcgcgcagtgaaattccagccgatgccattgagcaactggtttttggtcaggtagtacaaatgccggaagcccccaatattgcgcgcgaaattgtgctgggtacgggaatgaatgttcataccgatgcctatagcgtaagccgcgcctgcgccaccagttttcaggcggtagcgaatgtggcggaaagcctgatggccggcacgatacgcgcgggtatcgctggcggcgcagattcgtcgtcggtactgccaataggcgtgagtaaagccctggcgcgggtactggttgatgtcaataaagcccggacgacccgccaacggctgacgcttttttctcgtctgcgcttacgcgacctgctgcccgttcctcccgccgttgctgagtattccaccggtctgcgcatgggcgataccgccgaacagatggcgaaaacgtatggtattacgcgtgaacagcaggacgcgctggcgcatcgttcacatcagcgcgccgcgcaggcatgggcggagggtaaactggcggaagaagtgatgacgacctatgtgccgccgtataaaaacccctttgcagaagacaacaacattcgcggtgcctccacgctggcggactacgctaaactgcgtcccgcttttgaccgaaaacatggctccgtaaccgccgccaacagtacaccgctgaccgacggcgctgccgccgttattctgatgaccgaatcccgcgctaaagagctggggctgcgcccgcttggttatctgcgcagctacgcctttaccgctattgatgtctggcaggacatgctattggggccggcctggtcaacgccgctggcgctggagcgggccgggttgacgatggccgatctgacgctttttgacatgcatgaagcgtttgccgctcagactctggcgaacttacaactgctgggcagcgaacgatttgcccgtgaggtgtttggtcgtgcgcaggcgacaggggaggtggatgacgctaaattcaacgtgctcggcggctcaatcgcctacgggcatccttttgccgcaacgggcgcgcggatgataacccaaacgttgcatgaattacggcgtcggggcggaggttttggcctggtcacggcctgcgcggctggcggtcttggcgcggcgatggttctggaggcggaataatgactaccacatcagcttttatgcttagcgtgcgtctggataatgtcgcggttgtcgctattgatgtccctggagaaaaggtgaacaccctgaaagcggagtttgccgcgcaggtacgcgccatcctgaagcagatccgggaaaataaagcgttgcagggcgttgtttttatctcagccaaagcagataactttattgctggcgctgatatcaacatgataggccactgccaaaacgcgcaggaagcggaaacgctggcgcgtcaggggcaacaactgatggcggagatccaggcgttgcctgttccggttatcgccgccattcacggcgcctgtctggggggcggtcttgaaatggcgctggcctgccatcggcgtatctgtaccgatgacgttaaaaccgttctcggactgccggaggtacagttagggcttttaccgggatcgggcggaacgcagcgtcttccgcggctggtgggggtcagtaccgcgctggatatgatcctgacaggtaaacagcttcgcgccagacaggcgcttaaagccgggctggttgatgatgtggtgccgcaaactattttactggaagcggctgtcgagctggctaaaaaagaacgcctggcgcagcggactttaccggtccgtgaacgtatcctggcggggccgctggggcgcgcgctgttatttcgcctggtgcgtaaaaagacggcgcaaaaaacgcagggtaattatccggcgacggagcggatcattgatgtgattgaaaccggactggcgcagggcagcagtagcggctatgacgcggaagcgcgcgctttcggcgagctggcgatgacgccgcaatcgcaggcgctgcgcgctgttttttttgccagtaccgaggtgaaaaaagatcccggtagcgatgcaccgcccggcccgctgaacagcgtgggcatcttaggcggcgggttaatgggcggcggtatcgcctgggttacggcctgtaaaggcggtttgccagtacgaattaaggatataaatactcaggggatcaatcatgctctgaaatacagctgggatctgcttgaaacaaaagtacgccgccgccatatcaaagccagcgaacgcgataaacagttggcgttgatatcaggttcgaccgattaccgtggtttcagtcatcgtgatctggtcattgaagcggtgtttgaagatctgccgttaaaacaacagatggtggcggaagtggagcaaaattgcgctactcacaccatttttgcctccaatacttcttccctgccgattggcgatattgcggcgaatgcggccagaccggaacaggtgattggattgcacttttttagcccggtcgaaaaaatgccgctggttgaggtcattcctcacgcgtctacttccgcgcagaccatcgccacgaccgttaagctggcgaaaaaacagggtaaaaccccgatagtcgtcagtgataaagccgggttttatgttaaccgaattcttgcgccatatatcaatgaggcgattcggatgctgactgaaggcgaacgcgtcgaacatattgacgccgccctggtaaaatttggttttccggtggggccaatccaacttttggatgaggtaggaatcgacacgggcactaaaattattcctgtgcttgaggcggcgtatggagaacgttttagcgcgcctgcaaatgttgtcgcttcaattttgaatgacgatcgcaaaggtagaaaaaatggtcgcggtttctatctttatggcgaaaaagggcgtaaaagcaaaaaacaggttgaccctgctatttataagcttattggcgtgcaagggcagagtcgactgtctgcgcagcaggtggcagagcgctgtgtcatgttaatgcttaacgaagcggcgcgctgtttcgacgaaaaagtgattcgcagcgcgcgcgatggcgatatcggcgccgtgtttggtatcggttttccgccgtttctcggtggcccgttccgctatatggatgctctcgggccgggtgaaatggtggcgacattacagcgcctggccgcactttacggtcctcgttacgcgccttgtgaacaattagtgcgcatggcggagcgcagggagcatttctggacgaatggggaaactgaccagggaaattgaggtcaaagagaatatgaatccgcactgaatgcctccttagtggcgaaataataatcaaggattgactatacttacgccattgaggtaaaaaacagcgtttcattcggtgaatggataaggcacaatgccggccaccgcatttttgccgcagccaataggggcatgtggtaagcgtgttggtgaaactggttaacaaaagcggtgcaatatgcaagtttttatcatgcgtcacggcgacgcagccctcgatgccgccagtgattcggttcgtcccttgacctcttgtgggtgtgacgagtctcgcctgatggcgaactggctgaaaggtcaaaaagtggatatcgaacgtgttctggtgagtccgtttcttcgggccgaacagacgttagatgtggtcggcgattgtatgaatctgccgactcaggtggatgtcctgccggagctaacgccctgtggcgatgtcggtctggtcagcgcctaccttcaggcgctggccaatgaagagatcggatcggtgctggtgatctctcacttacctctggtcggatacctggtatctgagctttgtccgggcgaaacgccgccgatgttcacgacgtccgcaattgccaacgttacgcttgatgaaagcggcaaggggacattcaactggcaaatgagtccctgcaatctgaaaatggcgaaagcgatttaatctttgctgcctgataaggcgcttgcgccgccatccggcaattccgcatcagggtaattcgggcggttgccactcttccacttcaatcaacaccagcagcgcggcgtcgccgccgtactctttcggcgcctgatgaaaggccatcacatgcggatgctgcgccagccataacggcgtttgctgtttcagaatatgtttaccgtgtccatgcatgacgcaggcgcaaaaaatatgttcccgacggcaggcggcaatcagcgcccccagttcctgcttggcctgaagctgcgttaagccgtgtaaatccagaaacagttctggcgaatagtcgccgcggcgcattttttttagctcgaaatggctgacatcttcacggacatactttaccggcccttccgtattgagcagcggctggaactcatcagaaaaatagtggctggcgtccgcctgttcctgaattaaccttcgggtagggacttccgtgattttcttgcgcagtggccgatggacgatagtatcctgtttaatctttcgggtgccgaccatcagctgacggaacagcgcctggtcctcctcgctgagcgatgttttctttttcattcgtgggtctcgtctgatcttttgccttagtttacccgacccggaggatatccgaacggtcaaaacggatttttcgtattctcccgccgcgtcaatgctgatttatccctgtcttcgtggcaaactagccgccgaatttaatgcgagcatgccctggaggaatacgtggataaaattttcgtcgatgaagcagtaagtgaactgcataccattcaggacatgttgcgctgggcggtaagccgctttagcgcggcgaatatctggtatggacacggtaccgataacccgtgggatgaagcggtacaactggtgttgccgtctctttatctgccgctggatattccggaggatatgcggaccgcgcggctgacgtccagcgaaaaacaccgcattgtcgagcgagtgattcgtcgcattaacgagcgtatcccggtagcctacctgaccaataaagcctggttctgcggccacgaattttatgttgatgagcgcgtgctggtgccgcgttcaccgattggcgagctgattaataaccacttcgctggccttattagccaacagccgaaatatattctggatatgtgtaccggcagcggctgcatcgccatcgcctgtgcttatgctttcccggacgcagaggttgatgcggtcgatatttcgccggatgcgctggctgtcgccgagcataacattgaagaacacggtcttatccatcacgtgacgccaatccgttccgatctgttccgcgatctgccgaaagttcagtacgatctgattgtcactaacccgccttatgtcgatgcggaggatatgtccgatctgccgaacgaatatcgccacgaacctgagctggggctggcgtccggcactgacggcctcaaattgacccgccgtatcctgggaaatgcgccggattatctgtccgatgatggcgttctgatttgtgaagtcggaaacagcatggtacatctgatggagcagtatccggatgtgccgttcacctggctggagtttgacaacggcggcgatggcgtctttatgttgaccaaagcgcagttgctcgcggcccgtgaacatttcaatatttataaagattaaaacacgcaaacgacaacaacgataacggagccgtgatggcaggaaacacaattggacaactctttcgcgtaaccactttcggcgaatcacacgggctggcgcttgggggtatcgtcgatggcgtgccgcccggcatcccgttgacggaggccgatctgcagcacgatctcgacagacgccgccctggcacctcgcgctatactactcagcgccgcgaaccggaccaggtaaaaattctctccggcgtgtttgatggcgtgacgaccggcaccagtattggcctgctgattgaaaacaccgatcagcgctcgcaggactacagcgcgattaaagatgtttttcgcccgggacacgcggattacacctatgagcagaaatacggcctgcgcgattaccgcggcggtggacgttcttccgcgcgtgaaaccgcgatgcgcgtagcggcaggggcgatcgccaagaaatacttggcggaaaagttcggcatcgaaatccgcggctgcctgacccagatgggcgacattccgctggagattaaagactggcgtcaggttgagcttaatccgttcttttgccccgatgcggacaaacttgacgcgctggacgaactgatgcgcgcgctgaaaaaagagggtgactccatcggcgcgaaagtgacggtgatggcgagcggcgtgccggcagggcttggcgaaccggtatttgaccgactggatgcggacatcgcccatgcgctgatgagcatcaatgcggtgaaaggcgtggagatcggcgaaggatttaacgtggtggcgctgcgcggcagccagaatcgcgatgaaatcacggcgcagggttttcagagcaaccacgctggcggcatcctcggtggcatcagtagtgggcaacacattgtggcgcatatggcgctgaaacctacctccagcattaccgtgccgggacgtacgatcaaccggatgggtgaagaggtcgagatgatcaccaaagggcgccacgatccgtgtgtggggattcgcgcagtgccgatcgcagaagccatgctggcgatcgtactgatggatcacctgctgcgccatcgggcacagaatgcggatgtaaagacagagattccacgctggtaagaaatgaaaaaaaccgcgattgcgctgctggcatggtttgtcagtagcgccagcctggcggcgacgccgtggcagaaaataacccatcctgtccccggcgccgcccagtctatcggtagctttgccaacggatgcatcattggcgccgacacgttgccggtacagtccgataattatcaggtgatgcgcaccgatcagcgccgttatttcggccacccggatctggtcatgtttatccagcggttgagtcatcaggcgcagcaacgggggctcggaaccgtcctgataggcgacatggggatgcctgccggaggccgctttaatggcggacacgccagtcatcagaccgggcttgatgtggatattttcttgcagttgccgaaaacgcgctggagccaggcgcagctattgcgcccgcaggcgttagatctggtgtcccgcgacggtaaacatgtcgtgccgtcgcgctggtcgtcggatatcgccagtctgatcaaactggcggcacaagacaatgacgtcacccgtattttcgtcaatccggctattaaacaacagctttgcctcgatgccggaagcgatcgtgactggctacgtaaagtacgcccctggttccagcatcgcgcgcatatgcacgtgcgtttacgctgccctgccgacagcctggagtgcgaagatcaacctttacccccgccgggcgatggatgcggcgctgaactgcaaagctggttcgaaccgccaaaacctggcaccacaaagcctgagaagaagacaccgccgccgttgccgccttcctgccaggcgctactggatgagcatgtactctgatggacaatttttatgatctgtttatggtctccccgctgctgctggtggtgctgttttttgtcgccgtactggcaggatttatcgattctatcgccggaggcggagggctgctcactatccctgcgctgatggccgccgggatgtcgccggcaaacgcgttggcgaccaataaattacaggcgtgcggcggctccctctcgtcttcgctctattttattcgccgtaaagtggtaaacctggccgagcaaaagctcaatattctgatgacgttcattggctcgatgagcggcgcgctgctggtgcagcacgtgcaggcggatattttgcgccagatcttgcccatcctggtgattttcatcggcctctattttttattgatgccgaagctgggcgaggaagatcgccagcgccgcctgtatggattaccgttcgcgctgatagccgggggatgcgtcgggttttacgacggctttttcgggcctgccgcagggtcgttttacgctctggcgtttgtcaccttatgtggctataacctggcgaaatccacggcacatgccaaagtgcttaacgctacctccaacgttggcggcctgctgttatttatcatcggcggcaaagtgatctgggcgacgggctttgtgatgctggttggtcagtttttaggggcgcgaatggggtcgcgtctggtgttgagcaaaggccaaaagcttatcagaccgatgatcgttattgtctcggcggtgatgagcgccaggttactttatgatagccacggacaggagatcctccactggttggggatgaattaatgaacagtacgcaccattacgaacaattaattgagatttttaacggctgctttgccgaagaatttaatacccgtctgattaaaggcgacgacgaaccgatctatcttcctgctgacgcgcaggtaccgtaccaccgtatcgtctttgcgcatgggttttacgccagcgcgctgcatgagatttctcactggtgtatcgccggtaaggcgcgccgcgaactggtcgactttggttactggtactgcccggacggacgcgacgcgcagacccaaagtcaatttgaagacgttgaggtgaagccacaggctttcgactggttgttttgcgtggcggcggggtatccctttaaacgttagttgcgacaatctggaaggcgatattgagccggatcgcgtggcgtttcagcgccgggttcatgcgcaggtaatggcgtatctggagcagggcattcctgaacgtccggcccgcttcatcaaagcgctacagaattactatcacacgcccgaacttaaggcggaacagttcccgtggccggaagcgcttaattaaagccagcgccacgtttacaatgaggaaagaagatgatcgcggagtttgaatcacgcattctggcattaattgacgatatggtagagcacgccagcgacgatgagctttttgccagtggatacctgcgtggccacctgacgttagccattgccgagctggagagcggtgatgaccactccgttgaggcggtctatgccaacgttagccaaagtctggagaaagcgatcggcgccggcgaactgtcgccgcgcgatcaggcgttagtcaaagcgatgtgggacaatttgttcgacaaggcaaaacaataacgccgtggaccggaaggcgacgcttgccgccttccgctattgactggcccattacttcaccgcttttcccttcaataactttctcacccataaccgatttggatttaacgccgccagcgtaccggcatccagtggaatcggctcgttactcatctgcgccgccagaatttctgcgcataatggcgctgaacacaaaccacgcgatcccagcgcgccgagcataaataaacccggatacacaggcgcagacgccgccgacgttttattatcggctaaatcggcgtaatgcgtcagcgtggcgtggtaatccgggacattgcccaccatcggcagatggtcgcgggtggcgcaacgcacgccgcaacgggcgctgttgccgctaacgtcaacctctgtggcccagttcgcatccggaaaacagtcaagcagacgctgtcggttctgacgctgatcttcttcgcgccagacggtgctttcgtcgccccggtgatagctggcgccaatacagtgctgctgattatgcggattttgcggcgtcagatagccgtcgtagcataacacctgacgcaacgccgagagggcgggggtggtgggaatatgactgacctgccccccgacggcataaaccggcagcggccgggtctgatcaaaacggttaatctgatggccgttcgccaggacgacagtctcatggctggcggtttcacctgacgtaaagcgcagttgccagcgcgactcctgcgcaacgagcgacgtgagcgtatggcgaaagcgcgtttgtaaaccctgttcagtcgccagtgcgatgactgcgcgagttaattgttccgggcacagccagccgcctgccggataggtaattcctccgcagcgtgtcgtcacgccaaccgcctgttccgcctcttcggcattgagcgccgaggccagtccggcgggcagcgccagggacagcatctgggcaattttctgctggcttttctcatcccatccgagctgtgtcacgccgcaccaggcatgatcaaaagagacgggcagggcatcatacaggcgacgggcaaaggtgaatgcggtcgggaaaaagcgattaatggcggcgtcatgtttgctaaggagcggataaagcgcgccctgtcgattaccggaagcgccctgggcgggctgatcatctgcgcaatagagcgtcacctgccagccgcgacgcagtaacgccagtgataacagcgcgctggcgatgccgccgccaatgatcgccgtttcacgtttttcgcttccgctgcagtaaaaccagggcgcggaaagggtcggcatgaggtgttgttccatcactccacaaagcatctcgcgtttacgtccgaagcctttgtgtttttgcatggtaaaaccggcttcctgtaatccccgacggacgaaacccgccgaggtaaacgtcgccagcgttgcgccgggccgcgccagccgcgccatcgcgttaaacaggtttggcgtccacatatccggatttttcgccggggcaaaaccgtcgaggaaccaggcgtcgactgtttgattcagcgtggcgtccagttggtcggtcagctcattaatatcgccaaaccacaaatccagcgtcacccgaccccgatccagcaataggcggtggcaccccgggagcggcagcggccattgcgcctgcagctgctctgcccagggcgcgagctccggccagtgttggtgcgccagcgccagatcgtcgcgcgttaacgggaatttctcaaagctgatgaaatgtaacctttgcagcgtcgcctgtgggtgcgcagaacgaaagctgtcaaacgcctgccacagcgtcaggaagttgagtccggtgccaaaaccgctttccgcgactataaataatggatgtgaatgtacgggaaatcgctccgcaagacgattgccgccaagaaaaacgtagcgtgtctcttcgagtccattgtcattagaaaaatagacatcatcaaaatctcgggaaacaggtgtaccctcagcgttaaattcgagtgtggcgggttgtatggcgtattgtttcacgtaagttactcgtctgacgggcggtatcgcgatcttaacgatgtgtgcctgatggcgcaaatttccgtactaaatggctgatcggacttgttcggcgtacaagtgtacgctattgtgccaatcgaaacttaaaaatagtgcgaattacagaggtattgaatgaaacgtgcagtgattactggcctgggcatcgtttccagcatcggtaataaccagcaggaagtcctggcatctctgcgtgaaggacgttcagggatcactttctctcaggagctgaaggacgccggcatgcgtagccaggtatggggcaacgtaaaactggataccactggcctcattgaccgcaaagtcgtgcgctttatgagcgacgcctccatctatgcttatctgtctatggagcaggcagtggccgacgccggtctggcgccggaagtctatcagaataacccgcgtgtcggcctgattgcaggttccggcggcggctccccgaaattccaggtctttggcgcagacgccatgcgtagcccgcgtggtctgaaagctgtgggcccgtatgtggtgacgaaagcaatggcatccggcgtttccgcctgcctcgctacgccgtttaaaatttatggcgtgaactactccattagctccgcttgcgcgacctccgcacactgtatcggcaatgcggttgaacagatccaactgggcaaacaggacatcgtttttgctggcggcggcgaagagctgtgctgggaaatggcctgtgagttcgatgcgatgggggcactgtccaccaaatataacgatacgcctgaaaaagcgtcccgtacctatgatgcgcaccgtgatgggtttgtcatcgcgggcggtggcggtatggttgttgtcgaagagctggagcacgctctggcgcgcggcgcgcatatctatgcggaaatcgtcggctatggcgcaacatccgatggcgcagacatggttgctccgtctggcgaaggcgcagtacgttgcatgcagatggcgatgcacggcgtagacacgccgatcgactacctgaactctcacggtacgtccacgccggtaggcgacgtgaaagaactcggtgcaatccgtgaagtgtttggcgataacagcccggcaatttctgcaaccaaagcgatgaccggccactcgctgggcgcggctggcgtgcaggaagccatctactctctgctaatgctggagcacggttttatcgcgccgagtatcaacatcgaagagctggatgagcaggctgcgggcctgaacatcgtgaccgaaacgaccgagcgtgaactgactaccgtaatgtctaacagcttcggttttggcggcaccaacgccacgctggtgatgcgtaagttgtaagcctgactattacgttgtagtatcaacaatgaaacaggtcgctaatgcgacctgttttttcattcagggaacaacaaattatatggatattatataaatgccaactaatacattagataaaattaggcatagtttgagttgtgtggctgttttatttggtttgttcggcatttttgtttttgcctcattttcgccttcctatgcctggctttatttgggaggtctggctgcgccttttatatatagtattgtttttgtctacgcgattgccgcctggagtatttattcaaagtattatccgtttttatcattgggccgcttatcatttgtggaatgttttgttccggcgctggccctggtgtgccttaccgttctctacaatgtttttagtggcccggaaccctggatggccgagttatcaaggcaattttttcttcataaatttcttaacacgctggtgatgtgctttctggctcctgtggcggaggaaattatattcagagggtttttattaaacagcagtatcggttggggtcgatactcaagagtttccggtattattattacttcactcgcttttgcatttatgcatacacaatatctctttgcggtgacttttgtttatctgtttgttttttcatcgatattatgcgttgttcgaatgagaagccgtggactaatgataccgataacacttcatattttaaataatgcctgggttattttcggcttgctgttttcagcgacggaataagagcctgatgaaataggctctttaacctctccggtacgaacaagagaacgatggcggttcccttttttaatgcttctcatattccggcgcgacttttgctgaccaggcctcagcctgggtgatggcgcctgcgtcataaatcggctgttcataatccttatcagcatcccgaacgcggtaaattttccagcgtccctcttcccaacgggtataaacttccaggtggatgggcgttgactctgtagccaacagaacatccactttttctccgccgaggaaagggtgtgccttcccaacccgtaactgtggaatccactctggcgcatagtcctgcgcatacataaaataatctgcccctacaatctcctgttcataaagggactgtattagcgccaggcgatgaataacctctttagcaacgtaacgttgcattaaggcggtggtgtcgtcaggggtattcacatcgttcatgaacgtcgtcatccatgaggtatagaactgcttcacggcctgcgtactgtcgtgatgaggcgcagagcaactacaaagcaacaggataagcgcgacaagggagaacgttttcattaattcttcctgtagatggtatatgagggcctggctgcccggtagcccgggccggcccacatatcgcgttgtttaaaatctgaataccactctgcgccatcgtatatcgccatgtgaccgctcgggtttccgccagcgtaaggttgaataatgatgacgtcaccctcgcgcggcatttcataggtaccaatagcggtgaatccggcgcttcttaacattgggccataatctttcgcatgatatgtatgccccagcgtgataccgcccgcctgaattgcctttcgggtaaattccgcacaccggccttgagaatgagaacctgcatgcgttttggcataattaaccgccactcttttatcccaactcataatgattcctgttaataaaatacgtaatagcaattacgtaatgctttaacagtatttgattcgggaagcatgacagatcgtgctattactattttcaatataataagtttaaatatttattaattgttgagattgataagttaaagccaatttattcagcattaactattattctgcgatatcggcatcattttttatttgcatatcgccatagcgcgacggccagatctcctgcggcgtgatgcccagcgcgtccgcaataatccgttcggctctcggccaggaacgggtaaagacattgcgcagtgaatcaggtgataaaccggcctgacgagaaagatctctgagcgtaatacctcttttttccagtgcacttttaatatctgcacgatgccagtcttggctttttggttccattctgtaatcctaagaagatgtgttatcggcgccgatatttttaagataaaattagcgcatggaaaaggaagttactttctttttcacgctaagaatagtgccagaaagaaagcaaaatttcgcgaaaaagaagaaatatttttatttcatcaggggaaaggaaagaaaccgatggcaaaggaatggttcacggttaaggaatgtcttggcttaccggggtttccgggaagcgagcctgcggttcgcgaacgtttatataagtacagtgaagggaaagcgggggtcaggcgtaagcgtgttaaatcaaaggccgaggagtttcatatatctgttttccctctctatgttcatcgttatctggacgacagcggagaggaaccgacgccagaacccatttccttacaggaagcggagcctgaagatatctgggagatgatgttcaggttactgacgccagaacagcgcaagcaggtgactggacggtttaaggtgagagggatgaaagcggtctttctctttctgtttgatgacacgccgccgcgttgataccctggctgcaatttcaaggttgacaaatttcgcgtctcacaggcagacttcactttctacattatccttccgataatgcgtaagcgtttaacgttatccaacgcaccttaatcctgacgttcaggtagaggggggcgtggcctttccccgccttactctgcattctggagtaatgcatgacagcagttagccaaaaaacaacgaccccgtctgcggatttttcgctgttccgcatcgcctttgcggttttcctgacctatatgacgatcggcctgccgttaccggtcattccgctttttgtccatcacgaactgggctatagcaatacgatggttgggatcgccgtgggcattcagttttttgcgacggtactgacgcgcggctatgccggacggctggcggatcaatatggcgctaaacgatcggcgttacaggggatgcttgcctgcgggctggcgggcgccgcctggctcctggccgcgctgttgccggtttccgcgccggtaaaattcgcgctgcttattgttgggcgtttgatcctcggatttggcgaaagccagctgctgaccggaaccctgacctggggactggggctggttggcccaacgcgttccggtaaggtgatgtcgtggaacgggatggcgatttacggcgcgctggcggccggtgcgccgttgggcttgctgatccatagccactttggcttcgcggcgctggcggggacgacgatggttttaccgctgctggcctgggcattcaacggcaccgtgcgtaaagtgcctgcgtatacgggggagcgaccttcactgtggagcgtggtcgggcttatctggaaaccgagcctgggcctggcattgcagggcgtgggctttgccgtcatcggtacgtttatttcactttattttgtcagcaatggctggacgatggcgggattcaccctgaccgcgtttggcggtgcgtttgtactgatgcgcatattgttcggttggatgccggatcgctttggcggcgtgaaggtcgccgttgtctcattgctggttgagacggcagggttgctgctcttgtggctggcgccgacggcctggatagcgctggtaggcgcggcgctcaccggggcagggtgttcactgattttctcggcgctgggcgtggaggttgtgaaacgcgtacctgcacaggtacgcggtacggcgctcggcggctacgccgcgtttcaggatatctcctacggcgttaccggcccgctggcgggcatgctggccacgtcatacggctatccttccgtattcctcgcgggagcgatctccgcggtggttggcatcctggtgacgatattatcgttccggcgcggttaagaaaccagccagaaaagcgccagtacaattattagcgcgataaacaacaggcctggtcgcgcagacagatttttcacggtttcaatcatcggcgcaaacgggcggtagatgggttgaatagagagcggttcgagctcatccgcctcccgctctacgcgacgcaggaaaatatggttaagtaaatcctgcacctgcgcggtggtcagcaccgtttgcggctgaatttgataagtgtgttgggcatactctttgatcgctgtgagttcgtccggttccagcggttgttttaacgcagcttgcagcgtatgtagcgtaggcgcgtgttgtagtgacagcgtctgccgcgcctgtagccatgtcgccagatgggtaaactgttttgccgaaatgagctcgccgcttttcacgccggagagttccagcattgattgccagataagtttgtttgactcgccggtcgcggccgccagcttcgtcaccaactgattcaacgtattatgttcagcaggcaataatggccgatccgttgccggacgttgttgcggctgcggaatggaaagctgcccctgttgcaggagcgtcagcacgtttttgagttgatcgggcgtaagctggctaagcgcggtttgaccgtattgttgacggataaaatcgctgacggcctgacgattattcccgacgccaagcagctctgttagctgtgaaagcacctgacgattggcgtgattttgctgcgctacgcccagacgctgggtaagattctgttcagcggcggggaagtggcgcgacagtagcggcgcgtcattttttatccccagatcgtgtttcattccggcccatacttccgcgctttgctgctgggtcagtgaaatcaggcgcgtgatcagcctttccagtaccgtacgctgttgcatggaaagcggctgctcgctcgcagcggaaagaggattacgcccttcgcctggaggctgtgcaggggcgccggagatgggatgcataattaattatcctttaaccataaatctgagcaatatatgcttggcggccagattatggcacacttgtccggttaactctcgttctcaaacaggtacgacagtcgtgaaaattctcgttgatgaaaatatgccttacgcccgcgaattatttagccgcctgggtgaggtaaaggcagtgccgggtcgcccgatccccgttgaagaattgaaccatgccgatgcgttaatggtgcgttcggtcacgaaagtgaatgaatcgctgctgagcggcacgccgattaacttcgttggtactgctacggcaggcaccgatcatgtggatgaggcatggctgaagcaggcgggcatcggtttttcagccgcgcccggctgtaatgctatcgccgtggtggagtatgtgttttccgcgctgttgatgctggccgaacgtgacggcttttcgttacgcgatcgcactatagggattgtcggcgtgggtaacgtcggaagccggctacagaccaggcttgaagcgttgggtatccgcacgttgctgtgcgatccgccacgcgccgcacgcggggacgagggtgattttcgtacgctggatgagctggtgcaggaagcggatgtcctgactttccatacgccgctctataaagacggaccgtacaaaacgctgcatctggccgatgagacgctgatccgtcgactgaaacccggcgccattctcattaacgcctgccgcggcccggtggtggataacgccgcattgctggcgcgactcaatgccgggcagccgctgagcgtggtgcttgatgtgtgggagggcgaaccggatcttaacgtcgcgctactggaagccgtggatatcggcacgtcgcatattgccggctatacgctggaaggcaaagcgcgcggcaccacccaggtctttgaggcgtatagcgcgtttatcggtcgcgagcagcgtgtcgcgctggagacattactgcctgcgcctgagtttggtcgtattacgcttcacggcccgctggatcaaccgacgctgaaaagactggcgcatttggtgtatgatgtgcgccgcgacgatgcgccactgcgtaaagtcgctggaattccgggtgaatttgataaattgcgtaaaaattatcttgagcgccgtgaatggtcgtctttatacgtgatgtgtgacgacgaaacggcagccgccttgctgtgtaagctaggttttaacgctgttcatcacccggcacattaatgtcttcttaatgctccctgtcgaataatgcgacagggacgcttatgtatttctggagtaaatcaccatgtctgaaggctggaacattgccattctgggcgcaacgggcgccgtaggcgaagccctgcttgaaacactggctgaacgccagttcccggtcggtgaaatttatgcgttggcgcgtcatgaaagcgcgggcgagcacctccgttttggtggcaagtcggtcattgtccaggatgcggcggactttgactggacgcaggcgcagttggcgtttttcgttgccggcgcagaggcatcgactgcctggatagacgacgcgaccaatgcaggttgcctggtgatagattccagcggtctgttcgcgctggagcctgatgtgccgctggtcgtgccggaagttaacccgtatgtactggcggattaccgtaaccgtaacgtgattgcggtcgccgatagtctgaccagtcaactgctggcggcgctcaagccgttaatcgatcaggggggactgtcgcgcatcgccgtcaccagtatgttatcagcgtccgcgcaggggaaaaaagcggtcgatgcgctggccggacaaagtgcgaagctgcttaacggcataccgattgatgaagatgatttctttggccgccagttggcgttcaatatgctgccgctgctgccggatcgggaaggcagcgtgcgccaggaacgtcgtatcgtcgatgaagtgcgtaaaattttgcaggatgatggcgtgatgatctccgccagtgtcgtgcagtcgccggtgttctatggccatgcgcagatggtgagctttgaagcgctccgtccgctggcggcggaagaggcgcgcgaggcgttttcccgcggtgaagatatcgtactgtcagaagagacggattacccgacgcaggtgggcgacgcttccggcaatccacagctctctattggctgtgtgcataatgattacggtatgccggaacaaattcagttctggtcagtggcggacaacgtgcgtttcggcggcgcgctgatggccgttaaaattgcggagaagctggtgcaggagtatctgtactgatgtccggacagcaatcatcgccggtctataaaattgcgctgggtattgagtacgacggcagcaagtattatggctggcagcgtcagaatgaagtgcgcagcgtgcaggaaaagctggaaaaagcgctctcgcaggtggcaaatgaacctattaacgtgttctgcgccgggcgcaccgatgccggcgttcacggcaccgggcaggttgtccatttcgaaacgaccgcattgcgcaaagatgcggcatggacgctgggggtaaatgcgaatttgcctggtgacattgccgtgcgctgggtgaaaactgtaccggatgattttcacgcgcgatttagcgctacggctcgccgttatcgctatatcatctacaatcatcgactgcgtcctgcggtattagcaaaaggcgtgacgcattactatgagccgctggatgcagagcggatgcatcgcgcggcgcagtgtctgcttggcgaaaatgattttacctcgtttcgcgcggtgcagtgccagtcgcgcacgccgtggcgtaatgtgatgcacatcaacgttacccgccacggcccttatgtggtggtcgatatcaaagcgaatgcctttgttcatcatatggtcaggaatattgtcggcagcctgctggaagtaggcgctcacaaccagccggagagctggatcgcagagctgttagcggccagggacagaacgctggcggcggcaacggcgaaggcggaagggctatatttggttgcggtggattaccctgaccggtttgaccttccaaaaccgccaatgggcccgctatttctggcggactaatccgaatcgcacacccgaaacgtgtcgggtagaaaggcaaagacaaatatggacctgatctactttattattgattttattctgcacatcgatgtgcatctggcggagctggtcgcggagtacggcgtctgggtgtacgctattttgtttttgattctgttttgtgaaaccggcctggtcgtcacgccgttcctgccgggcgactcgctgctgtttgtcgccggggcgctggcttcgctggaaaccaacgatctcaatgtgcatgtcatggtggcgttaatgctgatcgccgcaattgtcggcgatgcggtaaattacacgattggtcgactgttcggcgaaaaactgttcagtaatccgaattcgaaaattttccgccgcagttatctggataaaacccaccagttttatgaaaaacacggcggtaaaactatcattctcgctcgcttcgtgccgatcgtcagaacctttgcgccgtttgtggcagggatggggcacatgtcctatcggcattttgccgcctataacgtcatcggcgcgctgctgtgggtgctgctctttacctacgccggttatttcttcggtacgataccgttgattcaggataaccttaagctgctgattgtggggattatcgtggtttcgatattacctggcgtcattgagattgtccggcataagcgcgctgcgtcgcgtgccgcaaaatagaaagtaactcaacggttcgaccacttttttatccaaagtttcgggctgttatgttttaatgtgcaacattcatggtctgttgggggcaaaaatggcattatgcgccccttataataaagctgactaaggttcaggcagaaaggtcaccaatgagctggattgaacgaattaaaagcaacattactcccacccgcaaggcaagcattcctgaaggggtgtggaccaagtgtgatagctgcggtcaggttttataccgcgctgagctggaacgtaatcttgaggtctgtcctaagtgtgaccatcatatgcgcatgtcggcgcgcaatcgcctgcatagcctgttagatgaaggttcccttgtggagttgggtagcgagctggagccgaaaaacgtgctcaagtttcgcgactccaaaaaatataaagacagactggcgtccgcgcagaaagaaaccggcgagaaagacgcgctggtggtcatgaaagggacgcttcacggtatgccggttgtcgccgccgcgtttgaattcgcgttcatgggcggctcaatggggtctgtcgttggcgcacgcttcgttcgcgccgttgaacaggcgctggaagacaactgtccgttagtgtgtttctctgcttccggcggcgcgcgtatgcaagaagcgctgatgtcgctgatgcagatggcgaaaacctcggcggcgctggctaaaatgcaggaacgtggtctgccctacatctcggtattgaccgatccgacaatgggcggcgtttccgccagttttgcgatgctgggcgatctcaacatcgccgagccaaaagccctgattggcttcgccggcccgcgcgttatcgaacaaaccgttcgtgagaagctcccgccaggattccagcgcagtgagttcctgatcgaaaaaggcgctattgatatgatagtccgccgtccggaaatgcgcctgaagctggcgagcattctggcgaagctgatgaatctgcccgcgccgaacccggacgccccgcgtgaaggcgtggtggtgcctccggcgccggatcaggagtctgaggcctgataactgaaaagggcagggccgcaggctctgcccttttgcttttcaccgtaaagaagcagcggaatcaatgaaaaacaaatctatacctcaagctgcgtcgcccctggcctcgtggctttcttatctggaaaacctgcacagcaagagtatcgatttaggccttgagcgcgtaagccaggtggcagcgcgtctggacatcctcaagcctgcgccgttcgtttttaccgttgcgggaaccaacggtaaaggtacgacctgtcgaacgctggagtcggtgttaatcgcggcgggataccgtgtgggcgtctatagttcacctcatctggtacgttacaccgagcgcgtgcgcgtgcaggggaaagaattagcggaatccgcgcataccgcgtcctttgcggaaatagaagcggcgcgcggcgatatttcattgacctattttgaatatggtacgttgtcggcattgtggctgtttaaacaggctaaccttgacgtggtgattctggaggtcgggttgggcgggcgcctggacgccacgaacattgtggatgccgatgtagcggtaattaccagcatcgcgcttgaccatactgactggctggggccggatcgcgaaagtattggccgcgagaaggccgggatttttcgtgcggaaaaacccgctatcgtcggcgaaccggaaatgccggcaaccatcgcggatgtcgcgcaggagaccggcgcgctgttgctgcgtcgcggcgttgactggcgttatgaggtgacagcgacccactgggcgtttaccgatggcgacggcacgcttgccggactgccgttgccgcaggttccccagccgaatgccgccaccgctctggccgcgctgcgcgccagcgggttgaacattgacgaacaggcgattcgcgacggtattgcgcaggctaccttgccgggacgttttcaaatcgtgagtgagtcgccgcgcgttatctttgatgtcgcccataatccccacgcggcggaatacctgacgggtcgtctgaaaatgttgccgaaacgcgggcgcgtgcttgcggtgattggtatgctgcatgataaagatatcgccggcacgttagcctggttgaaaagcgtggttgacgactggtattgtgctccgttagaggggccgcgcggcgcgacggcggaacaacttctggaacatctggggaaagggaatgtctatgatagcgtcgcgcaggcatggcaggccgctatcgacgcggcgcagccagaagataccgtgctggtgtgcggatcgttccacaccgtcgcacatgttatggaagtgatagacgcggggagaatcggtggcgagtaagtttcagaatcgtttagtcggcacgattgtgttagtcgcgctgggggttattgtgcttcccggtctgctggacggacagaaaaagcattatcaggatgaatttgctgcgattccactggtaccgaagcctggcgaccgtgatgagccggatatgatgcctgccgcaacgcaggcgctgccgacacagccgccggaaggggcggctgaagaggtgcgggcgggagatgcggcagcgccgtcgctggacccgtcgcgcatggcgtctaacaatgtcgagcttgatccgataccggtggagacgcctaaaccgaagccggttgaaaagccgaagccgcagcctaaaccgcaacagccggttgtcgccgtttccacgccgacgcccgcgccgcaaccggctaccgacgataaacctgcgccgaccggcaaagcctatgtcgtacagttgggcgcgctgaaaaacgcggataaagtcaacgagatagtcggcaagcttcgttccgccgggttccgggtttatacttccccctcaacgccggtacagggtaaaataacccgtattctcgtcgggccggatgcgtcgaaagataagatgaaaggatcgcttggcgagctcaagcagatttccgggttaagcggcgtggtgatgggatatagcccgaactaaggcgcgttttgcctgagcgcgcagcgttaaggcctatggtgttcatctggtaatagccgaagttctgtaggctggataaggcgtttacgccgccatccggcagaaggaataaaccgggtatcctgcgcttatcaggccgatggcagctcttctggtcgtgcccgaagagataaaaagtgtgatggcgttgaatattttttcagcgccatttttatttacgcgtgggaaggaaatccctacgcaaacgttttctttttctgttagaatgcgccccgaacaggacgacagggcgtaaaatcgtgggacatctatggtctggattgattacgccattatcgcggtgattgctttttcctgtttggttagcctgatccgcggctttgttcgtgaagcgttatcgctggtgacgtggggttgtgctttctttgtcgccagtcactactacacttacctgtctgtctggtttacgggctttgaagacgaactggttcgtaatgggattgctatcgcggtactgtttatcgcgacgcttatcgtcggcgctatcgtgaattttgtgataggtcagctagtagaaaagaccggcctgtcgggaactgaccgggtgttggggatctgtttcggcgcactgcgaggcgcgctgattgtcgccgccattctgttcttccttgatacctttaccggcttgtcgaaaagcgaagactggagcaaatcgcagctcatcccgcagttcagcttcatcatcagatggttctttgactatctgcaaagctcgtcgagtttcttgcccaggacgtaacaggttctgagatgtggcttaacgaggaaaatgacgtatgtgcggtattgtcggtatctccggtgttatgccggtcaaccagtcgatttatgacgcgttaacagtgctccagcatcgtggtcaggatgctgccggtatcatcaccattgatgcgaataactgcttccgcttgcgtaaggcaaacgggctggtgaacgatatttttgaagctcgccacatgcagcgtttgcagggcaacatggggatcggccatgtgcgctaccctaccgcaggcagctccagcgcttcggaagcgcaacctttttacgttaactcgccgtatggcatcacgttggcccataatggcaacctgactaatgcgcacgagctacgtaaaaagctgtttgaagaaaagcgccgtcatatcaacaccacctccgattccgaaatcctgctcaatattttcgccagcgagctcgacagcttccgtcactatccgctggaagccgacaatatttttgccgcgattgccgcgactaaccgtcaaatccgcggcgcctatgcctgcgtagcgatgattatcggccacggcatggtggcttttcgcgatccgcacggcattcgcccgttagtgctgggcaagcgtgacgttggcgatggtcgtacggagtatatggtcgcttctgaaagcgtggcgctggatacgctgggctttgaattcctgcgcgatgttgcgccaggcgaagctatctatattaccgaaaaggggcaactgttcacgcgccagtgcgcggataatccggtcagtaacccctgtctgttcgagtacgtttattttgctcgcccggactcctttatcgacaaaatctccgtctacagcgctcgtgtgaatatgggcaccaaacttggcgaaaaaatcgctcgtgaatgggaagatctggacatcgacgtcgtgatccctatcccggaaacctcctgcgatatcgccctggaaattgcccgtattctcggcaagccgtaccgccagggatttgtcaaaaatcgttacgtgggacgtacctttatcatgccgggccaacagctacgccgtaaatccgtgcgccgtaagctcaatgctaatcgcgcggaattccgcgataagaacgtcctgctggtggatgattccatcgtgcgtggcaccacatcagagcagatcatcgagatggcccgggaagctggcgcgaagaaggtttatctggcgtccgccgcgccggaaattcgtttccccaacgtctatggcattgatatgccgaccgccaatgagctgatcgcgcatggtcgcgaggtggatgagattcggcagatcatcggcgcagacgggcttatcttccaggatctgaacgatctgatcgaagccgtacgcgcagaaaacccggatatccagcagtttgaatgttcggtatttaacggggtatatgtcaccaaagacgtagaccagcaatacctcgacttcctggattcattacgtaatgacgacgccaaagcggtgctgttccagaacgaaatggaaaacttggaaatgcataacgaaggctaatggctttgccagcggcgcgatgccgctggccgatgtcaattacgcaccacgccgaagcgaatagcgtatttttgtactttgtactgtaacgtggtgcgggatacgttaaggctacgggccgcggcggcaatgttcccctgatgcgtatccagcgcggtttctattaaatgcctttcgtagttggcaacccgtacctccagcgacccttcatactgcggatcgggtgacgagggaaggggattctccggcgcggtttccggtacgcctaaatttaactcgtcctgttcaaaaatgatgtgtttcagcagcccgtctttttcctgcatgatcatgctgcgtacaatcgcgttttccagcatcctgacattacccggccaggcgtgattgagcagatcagcacgcgccgtctcgcttaatccgtgaatgtcctgcggcacgtcattacggtatttatcaataaaataattcgccagtaaggggatatcttccgggcgggcgcgcaacggcggtaacgtcaacattccgacgctcaaccgataaaaaagatctgcccgcaggcgttcttgttgaattaatttgacgggcgcttcgttcatggcggcaacgatcctgacatcagagtggagttgctgttgtccgccgagccgccagaaggttttatcctgcaagaatcgcagcagcttactttgcatttctatcggcatggcgttcagctcatcaagaaagagcgttcccccgtttgccagttccagatagccctggctattttccgcgccggtataggcgccgcgcacggtgccgaaaagcgtactttcgataagcgtaggcggtagagcgccgcagttcagggcgataaatggcttattcgcccgcttgctgcattgatgtatcaggcgggaaaatagctccttacccgttcccgtctccccgacaatcgtcaccggaatattactggcggccagccgtttggctttggcgatattactgagcatttccggattttcggtaataatggcatggtgcttctcatggtgatcggcatacagcagttggttcagttctaccacctgctcctggagccgcctgacgccggacatattcctgccgatttcgataacgccgaccatgccgccatcgcttgcatagagcgacgcggtggtgtgctgatagtcaacggcctggcctcgcgcattgtaataaatttgataatggccaatgtattccacgcctttttttaacgatgaaagcatcgtactttgggtttctttcatgcccggatagacatccagcatatgttttcccattgcccgttcaatgctgtagccgtccagatccgcgctttcctgattgtagtaaacgtattcaccacgctcattaatgacggccaacggctgatgaatcaaatcgaaaaagcgggaaaacatcctgagcgccgaggccagttcctgattggtggatgccatacatgcattcctcatatctattgttcatgttgccattataaaaatgacgaattttcgtcgttatgatgaatagcaaacttaatgacgaaaatgagaaacagcttatttttataaataattgattattttgataaaaaatagtggcatgccttttgctttatccctgtaaagaatgcggatttttaccataaacattaagcagagggcgttatgactgactcgattatgcagaattacaaccagctacgtgagcaggtaatcaacggcgatcgccgtttccagcacaaagacggtcatttgtgttttgaaggggtcgatctggacgctctggcgcgccagtaccccacgccgttctatgtgttttctgagccggagattattcgtaacattcatgaaatccagcaggcatttgcggcgcataaaaataccaaaaccttctttgcgtcaaaaacctgctcggtcatgggagtgttgaaagccattcgtgacgccggaatttgcgcggaggcaaactcacaatatgaggttcgcaagtgcctggagataggctttcgcggcgatcagatcgtcttcaacggcgtggtgaaaaagcctgccgatctggaatatgccatcgccaacgatctgtatcttattaatgttgatagcctgtatgagctggaacatattgatgccatctctcgcaagctgaagaaagtcgccaatgtttgcgtccgcgtagagccgaatgttccctcggcgacgcatgcggaactggttaccgctttccatgcgaagtcgggtctcgacctggaacaggcggaagaaacctgccgccgcattctggcgatgccttatgtgcatttacgcggcttgcatatgcatgtgggcgatcaggtgccggagtcagagcctttcgcaaaagcgactaaagtgctggtggatgaatcccgtcgcctggaagaggtgctcggtattaaatttgatttgatcaacgtgggcggcggaattccggttccctataaatatgacgacgagaatggcgacccgttaaaagataatatgtatgccggtattaccgcccaggattttgccgatgcggtcattcgcgaagtgcataaatggcgtaccgatgtggaaatatgtattgaaccgggacgtaaagtgaccgggtcggcggcggttttactgacggaagtctcctgcgaaaaacgtaaaacaaattacgatcttaacggcaatgtggaatgccacgttgaatggaaatttgtcgatgctggttacagcgtactctctgatagccagcattttgactggttcttttatgtctataacgcctctcgcatgacggcagcgcacgacgcctggataaaattagccgggccgctgtgtgatggcggggattatttccacatgggagtgaaaggcgaagagtttttactgccgaaggagactcatgttggcgatattgtcgcgtttcttgatgccggggcatacaccattgaaagtcaaaccgtttataacaaccgtccgcgcacgggggtggtgatgatcgataaaaatggtgagacgcgtctgattcgtcgggaagacagttacgaagatatggtcaagtacgacatttattaatactgttttgggcttcagtttcatgctgaagcccgtcgtcagatgataagaagagggcagtgatgcctgaatgcataacaggagatggccatgagtaacacgaattctggcttacttggcatcaaagacattgtctttatgaatgtcatcgctattctgagtttgcggcaaatccctaacgtggcgccttacggggcatcggccatgttgctatgggtgatagccgcattctgcttgttttttcctttagcgatggtatgcggcgagctgtcaaccggctggccgaaagatggcgggatatttgtctggattaaagaggcatttggtaaacgtattgcatggattgtcgtggtttgttttctcttttcctgcgtactgtttttcccattaatgctgcaattcggctttaccgcgttgggctatatgatcggcggcggcctggcggaaaataaagcgtttatcggtattggttccgcggtaattttctggctattaacgctgatgaatatccgcgggatggaatggacaaaaattattaatagcatcagcgcctggtgcgacgtatttattccctccgccatcctcattttgctggcggtggtatggctatgtaccggacaccagatgcagacggactacactacagcgaaaaactggattccggatctcggacactgggatacgatcgttttcttatccagcatgatgtttgcgtttgccggactggaggtcgccccgatgattgccgggcgtacccgtaatccacagcgtgattttccgcgagcgatggccgtctctgccgccgttatcgttgggatctatatggtcggcacctgggcgctaaatacgcttttacccgccgggaaaaccgacatcgtggcaggcgtcatgcaggctatgcatgctgctgcggacacgctgcatatgccgtggttaattcctgttatggccatctgtatgttttttggcgctctcgggcagattaactcctggctggtggggccgatttatatgctccaggaagcctcgcgtgaagataatctgctgggggaccgaatcggcaaattacatccggtgtggaaaacgcccgcctttgccttgactatacaggcgattattgtcacggtcctgtgtttttcgacttttatttcgccaagcgttgcggcggcttactggatgttaacggcgctaacgaccatcacctattttattccttatctggtgatgttcccggcgttctggcgtttacgtaagactcagccagatacgccaagaagttttaaaattccgggcaaggttttaccggctattttacccgcgctgggctttctttctatcgcctttgccgttgcgctgttatttattccgccttctcaaattgatatgggcggatatttccagtacgccgggaaaattattggcggagccgtgctggcggttgtcgtcgcggagtacatttaccatcgggcgcagaaacgtaatgcccgtttaagcatggcgggaggaaaataaaatgtatatgccagttctggaaataaatctacgcaagctggaagaaaacgcacgcacggaaaaagctctgctggcaagcagcggtattgacgtgatggctgtcaataaagtttttgacggctgcgtggaaaccgcgcaggcggtgttaaacggcggaattaccgttattgctgaatcacgaacctataatttgaaaaaaatacgcgagacaggatgtacgacctgcctgttacgcagcccgtgtctgagtgaaatcgaagatgtggtgcgctacgcggatattagtttaaatagcgagccggtggtattacgggcattatcgcaagaagcccaacgccaggggaaaacgcatcaggtattactgatggtgaatatgggcgatttacgcgagggtatctggtttggtgaatatcaacgcattcttgagaccgtgactctgattactggtctgcccggtctggaattatatggactgggcaccaactttaattgttacggcaccgtgttgccaacggtaaaaaatggcgaggattttctggcgctggccgcccggctggaagctgacagcggtattcctgtccggcggctttctgcgggaaactgcaccagctatcacctgctggataaaggtatctggccgcagggactgaatcatctgcgcatcggcggactgcatgaattcggcattgaatatgtggacatgaaatacctgaatgaatttcaccactccgcaaaaccggtcgataaagcctgttccgatatgtatatcctggaagcggaaatcatcgaactgaacagtaaaccgaccgtcccggtcggggagctgggcgtcgatgcctttttgcaaagtaaaacctttgtcgatcgtggcatacgccgacgcgcattgctggcgtttggtcgtcaggatgtgccgtcggataactgtgtgccatgcgacgacgctatcactatcttagggcaaaccagcgatcatacgctggtggatattgaagattgtcgtcagtcgctaaaagtaggcgatgtggttcgctttgagctggattatacgggcctgttaatggcctgccagaccaaaggcgtcgcctggaggtttacgcgttaacgcataaccgccgcggctatgtcgcggcggcatctttgacctcacgaaagacagggagtaacgatggataccctgcaacaatctccgccagcagagcctgaaggcggtctgcggcgtaacctgaagaagcggcacctgctgatgatgtcgctgggcggcacgattggcaccggcttatttatcggcattgccgaaccgttaagcagcgtcgggccggcgggaaccttactggcctatctgtttgccggaaccattatgctggcgacgatgatgtgtcttggcgaattatcatgcgcctttcctcactccggttcatttcaacattacgcgctgatgtttatgccgtcaccttgctggagctataccattggctggctttactggtttagctgggtcttttccctggcagccgacctcactgccgcagggtttattgctcaccagtttttccccgcggttccggtatatatgttctgcctggcgattctgctcatcctgacggctatcaatctcacctccgcaaaaagttttggcgaatgcgaatactggctttcggccattaaggtcttcgcgatcgtgctgtttatctgcgcgggcggggtcatgatctactcgctaatgggccatagtgactggcacccgacgttaaaaacagacggaatgtggtttccccacggttgggagcaaattgtggtctgtatgacgatcgtgatttactccttccagggggtggaactggtcggaaatgcggcaggggagaccgaatcgccgcacattattttaccgaaggtgatcctggggatcggtctcagaatcattttgttttacggcctggcgattgcggtgctggcgctggtctatccgcatgaactgacgccaaatggacaaagtccctttgtatgggtattctcccacgcgggcattccgggggcggatacgctgatgacgctggtgatcttttccgccgcggtttctgccgctaactcggccatttacgccagttcgcgtatgctgtggtctatggcgggcgatcgctttgcgccagcctgctttggtaaaacgaacggcggcggcgtgccggtgtatgctattttaatcacgaccttgctggcgttggtgtcgttgctgacccgctatattcccgcacagcaattttatttatatctgatcgccagtaccgggcaggtgggttgcctggcatggataaccatcggatggtgccagtatcgcttccgacaatcggtgcgtaatggcacgtacgccagcgatttgctacgctatcgatcgccgctttttccctggacggcccgatttgtcattatcaccaattttgccattatggtcggcacctagtttagtgagcagggagtagtgataatgttggttgagctggcttttatgatagggattcttttgtcatggtatctcttcagacccactttgagccggttacgtaacacagtgggatgaacggcgctcgtaaacggtaagaggacatgaaacgactcattgtaggtattagcggcgccagcggagcgatttatggcgtgcgcttattacaaattttgcgcgatgtcgatagcgtggaaacgcatctgatgatgagccaggcggcccggcaaacgctggcgctggagacccatttttcgctgcgcgaggtgcaggcgctggccgatgtgacgcacgatgcgcgcgacattgccgccagcatttcctccggctcttacccgacggcaggaatggttatcctgccctgttcgattaaaacgctgtcggggattgtccacagttatactgacggactgcttacccgcgcggcggatgtgatattaaaagagcggcgacctctggtgctgtgtgtgcgcgaaacgccgctgcatatcgggcatttgcgtttaatgacccaggccgctgagataggcgcggtgattatgccgccggttccggctttttatcaccttcctcagacgttagatgatgttataaatcaaacggttaaccgagtgttggatcaatttgacatcccccttccgcacgacctttttgttcgctggcagggcgcatagcgttgtctgtttagcgtgcattattgtccctgttgccctgtttcagggcaattttgtaaccgcgatcatatcctcaacatttaattcgttaaaagccgccgaaacgctgcggttcaaccgtcatacctgctatcttcaacatcaggacaatattgcaacgttttattaacaaatttaacgtcgaatcgttttgctgacgtgaaaatggcataagacctgcatgaaaaagtctgcaaacacacaacgccacgtaaaacataaaaaaatgacgccacttgaggggtatgtatgaagaagaccgttctcgctttgtctttgctgataggtctgggcgcgacggcggccagttacgccgcgctcccgcaaacggttcgtattggaacagataccacctacgcgcctttctcatcgaaagatgccaaaggcgactttattggctttgatatcgatctcggtaatgaaatgtgtaagcgtatgcaggtgaaatgtacctgggtcgccagcgactttgatgcgcttattccctcactaaaagcgaaaaaaatcgatgccattatttcatcgctctctattaccgataaacgccagcaagaaattgcgttttccgacaaactttacgcggcggattcacgcctgattgcggcaaaagggtctcccattcagccgacgctggaatcgctgaaaggcaagcatgtcggcgtgctgcaagggtccacgcaagaggcttacgccaatgataactggcgcactaaaggtgtggatgtggtggcttatgccaaccaggatcttatctattccgatttaaccgccggtcgtctggatgccgcattgcaggatgaagtcgccgccagcaaaggtttcctgaagcagccagcgggcaaagagtatgcgtttgccggtccttccgtgaaggataaaaaatattttggcgacgggacgggggttgggctgcgcaaagacgataccgagctaaaagccgcgtttgataaagcgctgaccgaactgcgccaggacggaacttacgacaaaatggccaaaaagtacttcgattttaatgtctacggcgattgagggaaggggataacgcgccgcgctggggaactatcacggtgcaaaatagatgttttgcacctttttggtgcataagccgttgcggaacaggcgcataaatgcatacttaatcgatttttatgcaaaataaaccggctgacaaggtagaatgctttgccttgtcggcctgattaatggcacgatagtcgcatcggatctgtaaagatctcctggaaagacagtctgttgaggatagttatgaaaaaactggcgttatccctttctctggtgctggcattttccagcgctaccgcagcatttgccgctattccacaaaagattcgcatcggtaccgatcctacatacgcaccgtttgaatccaaaaatgcacaaggtgaattggtcggctttgatatcgatctggccaaagaactgtgcaaccgtatcaacacacagtgtacgttcgtggaaaacccgctggatgcgctgattccgtctttaaaagcgaagaaaattgatgccatcatgtcctcgctgtccatcactgaaaagcgccagcaggaaatcgcgtttaccgacaagctttacgccgctgattcccgtctggtggtggcgaagaactctgatattcagccgaccgtcgcgtcgctgaaaggcaagcgcgtcggcgtgctacaggggacgacgcaggagaccttcggcaatgagcactgggcgccgaaagggattgagatcgtctcttaccaggggcaggacaacatttattccgacctgacggctggccgtattgatgcggcgttccaggacgaggtcgcggccagcgaaggtttccttaaacagcccatcggaaaagactataaattcggcggcccggcggtgaaagatgagaagttattcggcgtaggaaccggtatggggctgcgcaaagaggataacgagctgcgcgaagcgctgaacaaagcctttgctgaaatgcgtgctgacggtacttacgaaaagttggcgaaaaagtactttgattttgatgtttatggcggttaatcaccgtcggtgcagataaagcccaaagaatattgactgtctgcattgcctgagggcgctgtgcgcgtcaggcctacggggagcatcgtaggccgggcaaggcacagccgccatccggcgtgatgtgaggcaaaaatgcaaaagaggcttcttacttcaccacacacaacaggacaggctgcatgttgtacgggttttcaggcgtaattttacagggcgcgatcgtcacgctggaactggcgctcagttccgtggtgctggccgtgcttatcggtctcgtcggcgcgggggcgaagctttcgcaaaaccgggtaacggggcttatttttgaagggtacaccaccctgattcgcggggtgccggatctggtattaatgctgctgatattttacggattgcaaatcgcgcttaacgtggtgaccgattcgctgggtatcgaccagatagatattgatccgatggtggccggtattatcacccttggtttcatctacggcgcctattttaccgaaacctttcgcggcgcgtttatggcggtaccgaaaggccatatcgaggcggcgacggcctttggttttacccacgggcaaaccttccggcggattatgttcccggcgatgatgcgttacgccctgccggggatcggcaataactggcaggtgatactcaaagcgacagcgctggtgtcgctgctgggcctggaagatgtcgtcaaagccacgcagcttgccggtaaaagcacctgggagcctttctattttgccgtggtctgtggacttatctacctggtatttaccaccgtttccaatggtgtgctgctcttacttgagcgtcgctattccgtaggcgtgaagagggccgatttgtgattgagatcattcaggagtactggaaatccctgctgtggacggatggctatcgttttacaggcgtggcgattacgctgtggttgttaatttcatcggtggtgatgggcggtcttctggcggtgattctggcggtgggtcgcgtttccagtaataaattcatccgttttcccatctggctgtttacgtatatttttcgcggcacgccgctgtacgtacagctactggtgttctattcggggatgtatacgctggagatagtcaaaggcaccgatcttcttaacgcgtttttccgcagcggactgaactgtaccgtactggcgctgacgctgaatacctgcgcatacactacggagattttcgccggagcgattcgttcggtaccgcacggtgaaattgaagcggcaagagcgtatggcttctcgtcatttaaaatgtatcgctgcattattttgccgtcggcattacgcatcgccttgcctgcctacagcaacgaagtgattttaatgctgcactctacggcgctggcgtttaccgcgacggtgccggatttgttgaaaatcgcccgcgatattaactcagcgacttaccagccgtttaccgcgtttggcattgccgccgtgttgtatttactcatttcgtatgtcctgataagcctgttccgccgggcggaaagacgctggttgcagcacgtgtcctctaaataattcgagtaacatgatgtcagaaaataaattacacgttatcgatttgcacaaacgctacggcggtcatgaagtgctgaaaggggtatcgctgcaggcccgcgccggagatgtgattagcattatcggctcgtccggttccggtaaaagcacttttttgcgctgcattaacttcctcgaaaaatcgagcgaaggcgcgattatcgtgaacggtcagaacattaatctggtgcgcgacaaagacgggcagctcaaagtggcggataaaaatcagctacgcttgttgcgtacccgcctgacgatggtgtttcagcactttaacctctggaaccacatgacggtgctggaaaatgtgatggaagcgccgattcaggtactgggattaagcaagcacgacgcgcgcgagcgggcgttgaaatatctggcgaaggtggggattgatgagcgcgctcagggcaaatatcccgtccatctctccggcggccaacagcagcgcgtttctattgcgcgcgcgctggcgatggaacctgacgttttactgttcgatgaacccacatcggcgctcgatcctgaactggtcggcgaagtgttgcgcatcatgcaacaactggcggaagaaggcaaaacgatggtggtggtcacgcatgaaatgggcttcgcccgccatgtctcttcgcacgtgatttttctgcatcaggggaaaattgaagaagagggcaatccggagcaggtgttcggcaatccgcaaagcccgcgtttacagcaattcctgaaaggctcgctgaaataaaagaagcccggcggcgcatcgcttaccgggcaggatacggcgctttgggaattagcgaatcacatccgccagcgcctcttctaaatcataccagcgaaatgcgaatccggcggcttcaagccgttttggcagcgcccgctgtccgcccagtaccagcactgacgactctcccatcaataagcgaattgccgtcgccggaatgcgaataatcgccgggcggcgcagcgcgcgacccagcgcatgagcaaactgctcattatggacgggatacggcgagaccatattgaagggaccgcgaagatcgttatccagcagccacaggatgccgttgaccatatcgtcaatgtgaatccaggccagatattgccgaccattacccaccggaccgccgagtccgaggcgaaacggcggaaccattttccccagaatcccgccttgcggcgccaggacaacgccggtacgcagcaggcagacgcgggtctggtcgctctgcgcacgacagacaatctgttcccagcgggcgcaaagtttatgcgtaaattcgttgtgcggcggctcatcttcagtgacgacaacgtcgcccagatcgccgtaatagcccgtggcggagccggatatcaacaccgagggcggcgtagcgctggcatgaattaaatccaccaacttttgcgtgatagcccagcggctttggcacaaccgttctttttgttgcgacgtccagcgcttgtcggcaatcggttcgcccgccagattgatgatggcatcaatctcattgaggtgctcacgttccgccagccctttccataatgtcactctggaatcgagaatctgacgcgcgttatcgggattgcgcgtaacgaccgtcacctggtgccccagtattaacagccggggaatgagatgacgccctatcaggcccgtaccgccggtaatcagaatctgcatatgacctccagagtagggaggatttcctcttccctaatgtcaggtttttaatacgaataagggtgccggacgcaggttttccgtgtatacacctctacatcatacatgatgtatgctaccgcgttacgctttcgtactgttacagtgcagttgcgcttgtaacagtgcgcgcgctgtcgcaggacgcgtgcgaatgcgttcaaaccagttatacaccgccgggtaagtatcaagatcgattcgctgacgctgatgtgcgttaacccacggccaactggcgatatccgcaatactgtagtggtcgccgcccagccacggggaggtttccaggcgtttattcaggacgttgtataagcgttgcgtttcaacctgatagcgttcaatcgcataggggatggcctgtggcgcaaagtggttaaagtgatgattctggcccagcatcggccctaacccgccgacctgccagaacagccattgcagcgtggtatggcgttcacgcagctccccgctaagcagtttgccgcttttttccgctaggtagagaagaatttcgccggattcaaaaagactaagcggttgaccgccgtctgccggggcgtgatcgacgatggcaggaattttattattgggagagatagccaaaaaatcagggcgaaactgattgcccttgctgatatctacttttagcaaacgatacgccagctccgcctcttccagaaacagcattattttatgcccgttgggcgtgggggcgtagtaaaggtcaatcattttggctcctgcatgtgcgtaaagagtctgggctgaattaagtatagaaagcctcctgatgtgtgtgagttttcatcaggtgacagcaggcgaaagacgctatattttgggaagaaacctaatacgccctcaagaggacattatgagtaagcctgttattgtgctgtggtcggatgcgaactttttctctccctacgtcttgtccgcctgggtggcattacaagaaaaagggctttcctttactctgaaaacccgcgatctggaccagggagaacatctgcaacctggctggcggggatatgcgctgacgcagcgcgtcccggtgcttgaggccgacaattttgagctgagcgagtcgtccgctattgcggaatacctggaggagcgtttcgcgccgccgcagtgggagcgtatctacccgcacgatttacaaaaacgcgcccgcgcgcgacagattcaggcgtggctacgcagcgatttactgccgcttcgcgaagaacggcctaccgacgtggtgtttgccggggcgaaaaaagcgccgctaagcgaggctggaaaagccagtgcggcaaaactgtttgcgacggctgaagcgctattggggcaggggacgcaaaatttatttggtgaatggtgcattgccgataccgatctggcattgatgatcaatcgtctggtgctgcatggcgatgacgtgccggcgtcgctggcggcgtatgcgacatttcagtggcagcgtgcttccgtacagcgttttattgcgctttcctcgaagcgttcaggctgaaaatctattcatattccagtatcataacgccgtttttcacaatgaggagtgagcgatgaaactgatgttcgcatcggacattcatggttctttacccgccacggaacgcgtgcttgagcggttcgcgcaaagcggcgcgcgttggctggtgatattaggcgatgtccttaaccacgggccgcgcaatgcgctgcctgaaggctatgcgcccgcccaggttgccgaacgcctgaacgcggtggcgacgcaaatcattgccgtgcgcggcaactgcgatagcgaagtggatcagatgctgctgcatttcccgataactgcaccgtggcagcaaatattgacgcaagagaggcggctatttttaacgcatgggcacctcttcgggccgacgaatctgcccgctctgcatactggcgatgtgttggtctatggtcatacgcatctgccggtggcgcaacagcaggaaggactgtatcactttaatcctgggtcagtgagcatcccgaaaggcgggtatgcagcaagctacggtattctggatgataatgtgttgagcgtaatcgcactcaatgatcaaagtatcattgcgcaggttgcaattaactcgtaatttacctcacaaacgtaaatgcgccgtaagagcgccagaaataagaaggtttcctgatggtggaacagcgtcgtttggcaagtacggaatgggtggatattgtgaatgaagacaatgaagtcattgcacagtccagccgggaacagatgcgtgcgcaacgcttacggcatcgtgcgacgtatatcgtcgttcatgatgatatgggtaaaattctggtgcagcgtcgtaccgaaacaaaagattttttgcccggtatgttagatgctaccgcaggcgacgtggtccaggctgatgagcagctactggaatctgcccgccgcgaagcggaagaagagttgggtattgcaggcgtgccgtttgccgaacacggtctgttttactttgaagaccaacattgccgggtttggggcgcgctgtttagctgcgtttcccacgggcctttcgcgcttcaggaagatgaagtcagcgaagtgtgttggctgactccggaggagatcaccgcgcgctgtgatgaatttacgccggactcgctcaaagcgctggcgctgtggatgacccgcaacgccaaaaacgaagccgcgcttcaggagaaaccggaagagacggaataagcgttttagcagctttcccgcatacataaactggaggcgatagattttcgatcgctccagtttccctgatttaacctttccaacagcgcccgtccggcttcactgccaatcttacggtgcggtacggccatggtggttaacggcggctggcagacccggctgacatcgctatcgccaaacccgaccaccgctaaatcgtccggaactttgatccgccgtcgttggcactcgtataacgcgccgcaggccagctcatccgatacgcataccagcgcgtccagctccggccatgctagtaaaaactccggcagttgcgacgcgccggtagaaaaattgggcggcaaggcggcattaatcacccggtttggcgacatatggtggcgaagcatcgctttgtaccagccgtgcagatgttgctgaaaaatccactgctcctgattggcgcatagcagcccgatattctggtaaccgcgctgaatcagcatttccgtcagctcatacattgctgcaacgttatcaataccgatattcatatcaataggatcgctgcgaatcgcgcccatctccatcaccggaatagaggcatttttcagccactggcgcacggtagtgctatgttcgacgctaagcagaatcgccgcggcaatgttggaagccagcagcgtttcgagcagcttctcctcttgttccacgcgatgctgcgattccgccagcattatctggtagcctgcgggctgtaaaatttgttgcagcccggcgaacatttcagaacaccccgcttccgcaaggttcggtacgaccatcgcgatggtgtgcgaggaggcagacgccagcgcgctggcggcgagattaggcatatagcccagctcatgcactgccgcttcgattttttcccggagtttatcagagacctgttccggcgtgcgtaaggctcgtgatacggtcatcgtgcctacaccggcaagttgggctacatcggcgatagtcactttaccggtactgcgccgtttacggggtatcgacatacaaattcctgcgtcattacaacatgttgagatgcttttttattgtcgttctttgcttcgcatgactggcagtatacgccttaaatccgcttttttgctgtgatttcacaccatgattttaatttgatagcgctatcacaattctgagtaatagtcgctggtagcgctatctttgtgataacgatcgcagctaatatcgaatggcttgaataaagtttgttcataatttcatacaccgtgggggcgaataacatgctgggaacctggttatctgacgcaaccatcacgctacgggagagcgtggaaacgtggccgcaagcgctggaaatttgcggcaaacccctgctggacgcaggtgttatcgcaccggaatacattacggcgattgttcagcagcaccaaaagcttgggccgtattatgtattagcgccagggttagcgatgccgcatgcgaggccggaagagggggcgaaagggttaggtttatcgttactgaaactacagcgcggcgtttcatttggcgcagacgaattcgatccggttgacatcattattatgctggcggcgcctgataagcacagtcatatcgaaatgatatcggctctggcggaattattttccagtgatgtagatatggaaaaattacatcaggcaaaaaacctggaggacattaaaacgattattgaccgtttctgattttattccattttcttgcggtaaataacattgcgcccgtgcgtgatgcagaccaactctacttttaaaaggtgacaataatgaaaatcatggcaatttgcggttccggcctgggtagtagttttatggtagaaatgaacattaaaaaagtattaaagaaactcaatattgacgctgaagtggaacactccgatctctcatcggccacacccggggctgccgatctttttgtaatggccaaagatatcgcggccagcgccagcgtaccggaaagccaactggtggtgatcaataacatcatcgacatcaacgaactggaaacgcagctgcgcgcatggttcgctaaacaataattattgctggcgaggtggatatgtttatccttgaaacgctgaattttgttgttgatattttaaaagtgccatcggtgcttgtagggttaattgcgctgattggtctggtggcgcagaaaaaagcgttttccgatgtggtaaaaggcacgattaaaaccattttaggttttattgtgcttggcggtggcgcaaccgtactggtgggttcattaaacccgctagggggtatgtttgaacacgcttttaatattcagggtattattcctaataatgaagcgatagtctcaatcgcgctggaaaaatatggcgcgtccacggcgttaattatggcatttggtatggtggccaatattgtcgtggcgcgctttacgcgtcttaaatatatctttttgaccggacatcacaccttttacatggcctgtatgattggcgtaatcctgaccgtggcggggtttgagggcgtagggctggtcttcaccggatcgctaatcctggggctggtgatggccttcttcccggcgttggcccaacgttatatgaggcggattaccggtaccgatgacattgcgtttggtcacttcggtaccctgggatatgtgctttccggctggattggcagcctgtgtggtaaaggctcccgctccacggaagagatgaacctgccgaaaaacctcagttttttacgcgacagttctatctcgatttcgctgaccatgatgattatctatctgatcatggcagtcagcgcagggcgtgagtatgtcgaagcgacgtttagcggcgggcaaaactatctggtgtacgccattatcatggcaatcaccttcgccgccggcgtattcatcattctgcaaggcgtccgtctgattctggcggaaattgttccggcctttaccggcttttcagaaaaactggtgccaaacgcgcgtccggcgctggactgcccggtggtgtatccctatgcccctaacgcggtactgattggcttcctgttcagttttctcggcgggctggtggggctgttcctgcttggacagatgaagcttgtgttaatcctgcctggcgttgtgccgcacttctttaccggcgcgaccgcaggcgtctttggcaatgccaccggcggtcgccgcggggcgatgatcggcgcatttgctaatggtctattaatcactttcctgccagtgctgttactgccggttctcggcgcgatcggcttcgccaataccacgttctcggatgctgactttggcgtaatcggtattttgctgggcaacctggcgcgttatctgtcgccgatggctatcacggggctggtggtggcgctattcgcgctactggtggcgtacaacgtgttggccaaaagcaaaaaagcgactgccgaagtgcaggaaaatagcggagcgaaagaatgaacgtaaccgaaatcacccaactggcgcgcgacattcgcgtcgccacgctcaaatccttaaaccatcttggctttggtcactatggcggcagcatgtcggtagtggagactctggcggttctgtacggcgcggtgatgaaaatcgaccctgccgacccggactggccggagcgcgattacttcgtactgtcgaaaggccatgcgggccccgcgttgtacagtaccctggcgattaaaggctatttcccgcgcgaagagctgaatacgcttaaccagaacggcacccgtcttcccagccatccggatcggctaaaaacgcacggcgtggacgccacgaccggctcactgggacaaggcatctctattgcgggcggaatggcgttgtcgtataaactggcgcggcgacccaaccgggtattttgcattgtcggcgatggggagctgaatgaagggcagtgctgggaggcgtttcagtttattgcccaccaccgcctgaataatctgaccgttttcattgactggaacaaacaacagcttgacggcgagctggaggagattatcaatccattcgatctggaagggaaattccgcgcgtttggtttcgatgtcgtcaccgtcaaaggcgatgatatcgccggactactggcggtggttcagcctgtgccgcccgctgatgcccggccacgggttgtgatccttgacagcattaaagggcagggggtgccatgcctggagcagttaacgaattctcaccacttacgcctgacggatggcatgaagcagacgctcaatgaggccattcatcaactggaggtcatgcatgattaagcttgcgcccgcagggcttaaagacgatatcgaaatgcgcaaagtttatgccggttttgtcgccgggcagattgaggccggaagcccaattattgcgcttgaggctgatttaatgagctcgatggcgatggacagcgtggcgcgtgactacccgcagcatgtcattaactgcggtattatggaggcgaatgtgattggcacggcggcgggactggcgctgaccggtcgcaaaccgtttgtgcatacctttaccgcttttgccagccgtcgctgttttgatcagctctttatggcgctggattatcagcgtaacaacgtcaaagtgatcgcctccgatgccggagtgacggcgtgccataacggcggcactcatatgtcttttgaagatatggggattgttcgcgggctggcgcactctgtagtactggaggtgacggatgcggtgatgttcgcgaatattttacgccagctaatggacctggacggtttttactggctgcgtaccatccgtaagcaggcgacgagtatctatgcgccaggctctacctttaccattggcaagggcaacgtactgcgcgagggcgatgatattacacttatcgccaacggcattatggtggcggaggcgctggaggcggcgcgccaactggagcaggaaggcgtgagcgctgcggtcattgatatgttcaccttaaagcctatcgatcgcatgttggtgaaaaactacgcggaaaaaacgcggcgtatcgtcacgtgtgaaaaccacagtatccataatggactagggtcagcggtagcggaagtgctggtggaaaactgcccggtgccgatgcgccgtgttggcgtcaaagagcgttatgggcaggtaggaacgcaggatttcttacaacaagagtacggactcaccgccgcagcgattgtagaagccgcgaaatcactgctttaatcatggagatattgccggatggcgctgatgctcatccggcattttggatcaatgatatcccatcatctgcgcgccaatcacgaccacgctggacatgataaacagcagtcccagcagcgacgcccccactttaagccagttgcgaaaatcgacccggcacacgcccagcgtggccatcagcgaagctgatgtcggatagataatatggctgaagccatcgccaaactggaaggcaagaacagtcacctgacggttaacgtcgaccagatcgccgagcggcgccagtaatggcatggttaacgccgcctggcccgaaccggacgtgacaaagaaattaaataccgcctggaagagcagcataaaccaggcggcgatagcattattaagcccgctgatgccatgcgcgatactgttaagcaacgtattgagcacgctgggttccccggcttcgccgttgccgaccagcagcagaatgcctttggcaaaacccaccagcaaggcgggcgcgatcatcatcctcgccccttcggtgaatgaggacgccatcacgttgaccgtcataccgttgaggcggaagataacgccgatgaggccgatcaccacgcccatggtgaaaaactggctggcgatctccggaataaaccaggcgtggacaatcacgccccagacgacccaaatcattacgccggtcagaaccagcagtaccagccagtcgccgaaggtgaaagggcgctggacgacttcatcctgctgttcgcggaaatagcgatcggattcgtggacgcgggaaagcagcggattctttttcacgcgtgaggcgtagaccagcgtaaaaaccagcccaatcagcgtggcgacaatccagaccacaatacgcagcccggagccggaaagtaccggcacgccggcaatcccctgggcgacgactacgcaaaacgggttcatccacgaactggcaaagccaatttgggtggcgatataggtcaccaggacggtggtaatgctgtcatagcccagcctgaccatcagcggggctatgataattgcaaaggcgaccgcctcttcgcccatgccaaatacggcgccccctaacgaaaagaggacaaatagcaccggaataaacaggacttcgttgccccgcgtgtggcgaataagcgccagaatgccgttatccacggtgccggtacgcatcacgatgccgaatgcgccgccaatcaccaacataaacataatgatgccgacggcagtgccgaatttcgatccggatgttaacccttcaaacggaaaattcatcagccctggtctttcatcgccggtagtgaaaaattgtacgcgatgatactgcgcttctccggcctcattggtcacaatgcgaaaagagtgcgggtcgacgactttgcgggtttttgtctgaccatcgacctgatactgcacttcctggctatcaaacatcccaacggggacgacccaggtggcgatactggttaaaatggcgacaaaaaagatgatgaccagcgtatcgggcattgcccattttctggctgtttttgattctgtaacgacagacatgacggactatccctgttgcaaagcaaagaggccaagtatgagaagaagggaatagttattcattgatgcagcgcagttaagcaaaaaattccgctttgcagggtaaatagcagaatgccggatggcgatgctaacgcgtcttatccggcctacaacggtatctcacctgtaggccggacaaggcgttcacgccgccatccggcattagcttttactgttactgctgctgttgagaagcctggatcgccgtcagggcgatggtgtagacgatatcgtcaaccagcgcgccacgggacaggtcgttcaccggcttgcgcataccctgcagcatcggcccgatggagatcaggtcggcagaacgctgtaccgctttgtaggtggtgttaccggtgttcagatccgggaaaatgaacacggtagcgcgacccgcaaccggcgagttcggcgctttggatttcgctacgtcagccatgaccgcggcgtcgtactgcaacggaccgtcgatcatcaggtcaggacgtttttcctgcgccagacgcgtcgcttcacgtactttctctacgtcgctgcccgcgccagaggtgccggtggagtaggagagcattgccacacgcggttcgatgccgaaggcaatggcggaatccgcagactgaatcgcgatttctgccagctgctctgcagtcgggtctgggttgattgcgcagtcgccgtaaacgtaaacctgttccggcagtagcataaagaacacagaagagaccagggagctacccggcgccgttttaataagctgcagcggcggacggatggtgttggcggtggtatgaaccgcgccggaaaccaggccgtcgacttcgtcttgctccagcatcagcgtgccgagcaccacgttgtcttccagctgttcgcgggcaaccggttcggtcatgcctttgctcttacgcagctcaaccaggcgagcgacatagctttcacgcaccacttccggatcgacgatttcaatacctgcgcccagctctacgccctgagatgccgcgacgcggttgatttcatccgggttgcccagcagtacgcaagtggcgatgccgcgttcagcgcagattgccgccgctttgacggtacgcggttcgtcgccttccggcagcactacgcgtttaccggctttacgcgccagctcagtcagttggtagcggaacgccggcggagagagacgacggctacgctcggaagtggcggtcagcgactcgatccagtcagcgttaacgtagttcgcgacgtattcctgaactttctcgatgcgctcatggtcatcaaccggaacttccagattgaagctttgcaggctcagcgaagtctgccaggtgttggtgttcaccataaagaccggcagaccggtggcgaatgcgcgttcgcacagtttagaaatgcgcgcgtccatttcatagccgccggtcagcagcagggcgccgatttctacgccgttcatcgcggccaggcaagctgcgaccagtacgtccggacggtcagctgaggtcactaacaacgatcctgcgcggaaatgctccagcatatgcggaatactgcgcgcgcagaacgtaacggatttaacgcggcgggttttgatatcgccttcgttaatgatggtggcgttcaggtgacgcgccatatcgatagcgcgggtcgcaatcaggtcgaagctccacggcaccgcgcccagaaccggcagcgggctggattcctgcagtttagcaggatcgattttgatcacctgcgctttggaagagtcgtcaaaaatctctgacagatccgggcgagtacggccttgttcatcaaccggcgcattcagtttgttgatgataacgccggtgatgttggtgtttttcgcgccgccgaagctgctgcgcgtcagttcgatacgctcgttcagctgttctggcgtgtcggtaccctgagacatgacaaaaacgatttccgcattcagcgttttcgcgatttcatagttcagagactgagcgaactgatgtttacgggtcggaaccagaccttcaaccagcaccacttccgcgtctttggtattcgcatggtagtttgcgatgatctcttccatcagcacgtctttctggttgctggagagcagagattcaacgtggctcatcttcagcggttcagccgccggcagggtagagttcgcgcgaacgatagtggtggtctggtcaggcgcatcgccgccagcgcgaggctgggcgataggcttaaagacgctcagacgaacgcctttgcgttccatagcacggatgacgccgaggctgacgctggtcagaccgacgctggttccggtagggatcagcataataatacgggacacggtttatcctctttcgttaccgtcttttggggacgggttacaaaacagcaccgccagcgaggctggcggtgtgaaatcaggcagtcagacggctcgcgtcctgcgcgataaccagttcttcgttggttgggatcaccaccgccggacgggtaccttctttgttgatgaaaccagatttgccgaagcgggccgccaggttacgttcgtggtcgacttcaaagcccagtacgcccagtttgcccagagacagctcgcgaaccatcgcggcgttttcaccgataccgccggtgaacacgactgcatccagacgaccgtccatcagagcggtgtaagaaccgatgtatttcgccaggcggtggcagtaaacgtccatcgcacgttttgcgtcttctttggtggcgtagttgtcttcaacataacggcagtcgctggtcacttcagtcagacccagcagaccggactctttggtcagcattttgttgatctgatccacgctcatgcccagagtgtcgtgcaggtggaagataatcgcagggtcgatatcgccggaacgggtacccatgaccaggccttccagcggggtcagacccatagaggtatccacgcatttaccgttacggatagcggaaacagaaccgccgttgcccaggtggcaggtgataatgttcagttcttctaccggcttgttcagcatttttgccgcttcctgagttacatagaagtggctggtgccgtgtgcgccatagcgacgaacgccatgttctttatacaggctgtacggcagggcatacaggtaagattcttccggcatggtctgatggaaggcggtgtcgaacacggcgacgtttttatctttcagctgcgggaaagatttcagcgcttcggcgataccaatcaggtgagccgggttatgcagcggtgcgaaagaggcggaatctttgatgccctgaatgacggactcatcaatgactacggagctggtatacttctcgccgccgtgtacgatacggtgaccaattgcagttaactgcgcagacagttctggtttttgtgccagaatagtgttaacgataaagttcagcgcttcactgtgagcggcgcctgcacctaaagccgcttcttgtttactgccgtccattttccatttgatgcgtgcttctggcagatggaaacattcggctaaaccagaaaggtattcatcaccattaactgcatcaataattgcaaatttcagtgaagaactaccgcagttcagaaccagtactaacttactcgacatggaagtacctatttatgatacgtggctaaaaaaacgtcagtgagccatagagcgtagcgcatgatagccctgacatttatgattaacatcatgcgcaggagtttttttgggcatgatggaagaaatacctttgagtctatgccattttgcgtatttttcagccaatggcatactatgtgtaatattgacgactcaatgattttaaactaccggcctttgacaggccgacacaggatacctgatagtgggtatcgaagacaaaatgttttgaacgttgtccctcgcagttgttgttttgcacaaattttttaaattttatatgtgaaattgaggtaggccatgtcgacgccggataatcgctccgtaaatttttttagcttatttcgccgggggcagcactacgcgaagacgtggccgatggaaaagcggctggcgcccgttttcgtcgaaaaccgcgtcattcgtatgacgcgctatgccatacgatttatgccgcctgtcgccgtctttacattatgctggcagatagcgctgggcggtcagttaggtccggccgtggcgaccgccctgttcgccctgagcttgcctatgcagggattatggtggttagggaaacgttccttgacgccattgccgccttcaatccttaactggttttacgaagttcgcggtaaattgcaggaggctggacaagcgctggcgccggtagaaggaaagccggattaccaggcattagctgacacgcttaagcgcgccttcaaacaactggataaaactttcttggatgatttgtaattgaccccggattacgcatataaaagaaggcataccaatgccttctttttttcatcgccatagcgtgatacaggagttcaaaatggaaatgaccaacgcgcaacgtctgattttgtctaaccagtacaaaatgatgacgatgctcgatcccaccaacgccgagcgttaccgtcgcttacaaacaattattgaacgcggctacggcctgcagatgcgcgagctggatcgcgagtttggcgagctgacggaagagacctgtcgtaccatcatcgatattatggagatgtaccatgcgctgcacgtctcctggaccaacctcaaagatacgcaagccatcgacgaacgtcgcgtcaccttcctggggtttgacgccgcgacggaagcgcgttacctcggctatgtccgttttatggtgaatatagaaggacgctacactcactttgacgccgggacgcacggctttaatgcccagacgccgatgtgggaaaaataccagcggatgttgaatgtctggcatgcctgcccgcgtcagtaccacctgagcgcgaatgaaatcaatcaaatcattaatgcctgaggaggctcacgtgcagtgtaaaggttttctgtttgatctggatggaacgttggttgactcattacctgccgtcgaacgcgcgtggtgtagctgggccgatcgttttaaccttgctcatgatgaggtgctgggctttattcatggcaaacaggcgatcacctcgttgcggcattttatggcgggtaaatcggaggcggaaattgccgctgagtttacgcgcctggagcaaatagaagccactgaaaccgcagggatcaccgcgttgccgggggcagtcgatttactcaatcacctgaataaagcgggcattccgtgggctatcgtcacctccggttcaatgccggtcgcgcgtgcgcgccatcaggtcgcgggccttccagcgccagaggtgtttgtcaccgccgaacgagtcaaacgcggcaaaccggagccggatgcgtatttgctgggcgcacaactgcttggcctggcccctcaggagtgcgtcgtagtagaagatgccccggctggcgtgctgtccggactggctgcgggctgccacgtcattgcggtcaatgcgccggccgacacgccgcgtctggcggatgttgattttgcgttggatagcctgacgcaattatcggtcgctaaacaaccaaacggcgatgtggtggtgttaagaaagacctgatcatgatatgccccgccctggcggggcatatttatggcagaatcacgttatcttctcatctgacaaggatatgttgtgaacggtgaattgatttgggttctctctttactggcgattgccgtcgtgttgtttgcgacgggcaaagtacgtatggatgcggtggctttattcgtcattgttgcttttgtccttagcggtaccttgaccctttcggaagccttctccggctttagcgatccgaatgtcattcttatcgccgccttatttattattggcgacggcctcgtgcgcaccggcgttgcgacggtggtcggtacctggctggttaaaatggcgggcagcagtgaaatcaagatgctggttttactgatgatcaccgtcgccggacttggtgctttcatgagttcaaccggcgtggtggcgatttttatccccgttgttcttagcgtttctatgcatatgcagacctcgccttcgcgcctgatgatgccgctgagttttgccgggcttatcagcggaatgatgacgctggtggcgacgccgtcgaacctggtggttaacagtgaactgctgcgtgaaggcctgcacgggttcaacttttttagcgtgacgccgctgggggtagtggtgttggcgctcggcattgtttatatgctggtgatgcgcttcatgctaaaaggcgatgcgcccggacaacaggccggtaagcgtcgcactttccgcgatcttatccgcgagtaccgtctgacggggcgcgcgcgtcgtctggcgattcgccccggttcgccgatggtgggacagcggctggacgaccttaaactgcgcgaacgttacggcgccaatgtcatcggcgttgaacgctggcggcgctttcggcgggttatcgtcaatgtgaacggcgtatcggagtttcgcgctcgcgacgttctgctgattgatatgtcggcggcggaggttgacctcagagagttctgcgccgagcaactgctggaaccgatggtattgcgtggagaatatttttccgatcaggcgttggatgttggcatggcggaaatttcgcttattccgaagtctgaactgataggcaagtcggtgcgtgaaatcgccttccgtacacgttacgggctgaatgtggtcggcctgaaacgcgacggcgtcgcgctggaagggtcgctggccgatgaaccgttattgatgggcgatatcattctggtcgtggggaactggaagttaatcagcctgctggggcaaaaaggccgcgactttgtggtgctgaatatgccggtcgaggtcagcgaagcctcgccggcgcacagccaggcgccgcacgccattttctgtctggtactgatggtggcgctgatgttgaccgatgaaattcccaatccgagcgcggcgattatcgcctgcctgctgatggggaaatttcgctgtattgatgctgaaagcgcgtataaagcgatccactggccgagtattatcttgattgtgggtatgatgccgtttgcgctggcgttgcaaaaaaccggcggcgtctctctggtcgtgcaagggttaatggatatcggcggcggctatgggccgtatatgatgctgggatgcctgttcgtgctgtgcgccgtcataggactgttcatttctaacacggcaacggcggtgctgatggcgccgattgcgctggcggcggcgaaatcgatgggggtgtcgccctatccgtttgcgatggcagtagcgatggcggcatccgccgcctttatgacgccggtttcatcgccggtcaatactctggttctggggccgggaaactatagctttagcgattttgtgaagcttggcgtgccgttcacgcttattgtgatggcggtttgtattgtgatgattccgatgttgtttccgttttaaccccaggctggaaaaggcctgatggcgctacgcttatcaggcctacgggaagaacggtaggccggataaggcgttagccgccatccggcaactaaagcggtgaatcctggcttatctcgtcaagagagagatggaaacttggcacgaacaccgccataaaatagtccatctcctggctgcgacgtaattccagcgttttttccagccgcgtttttgccagtctaaactcattatttcccgctgagagctcctccaggcatttcaggtaggcgcaaagcgcatcggcctgctttacgattgcctgttcttctttgctccaggcattctcatcaataagcggtgcgaaaatatcgtgtaattcatccggcgccatatcaaccagcttttgctgggcgattttttcgatcgctttatattcctgagctatctgggaattaaaatattttaccggcgttggcagatcgccggtcagtacttccgaggcatcatgatacatcgccagaagcgcgatgcgttcagcattgagctggccgccaaatttacggttttttatcgccgccaacgcatgggcgaccatcgccacctgcagactatgttcggagacgttttccgtacgcacgttacgcatcagcggccagcggttaatcaacttcatgcgggagagatgggcgaaaaaatggctctgcttcatagattaccttttgttttcactgcggcagacttcattgtgcggggagggtgatgaagatgcaattcaggctaccgaagtagcctgaatttaagattattgatggtagcctgagaggaaacgcccaaagcggttgatggccatctccaggtcatcttcacgcggtagcgtcacaatgcggaagtgatccggccacggccagttaaaggcggtaccttgcaccagcagcaccttttcctgtagcaggaagtccagcaccatcttctggtcgtcgtgaatattaaaacgtttagcgtcgatcctggggaacatgtacaacgcgccgcgcggttttacgcaggaaacgccgggaatatcgttaatcaactcccaggcgcggttacgctgttcatacagtcgaccgcccggcagaataaattcgctaatgctttgatagccgccgagcgcggtctgaatagcatgttgcgccgggacgttggcgcacaggcgcattgaggctaacatctccagcccttcaatatagcctttcgcatgttttttcggcccgttcagcaccatccagccctggcggaagccggcgacgcgataggttttagacaaaccattaaaggtgatggtcagcagatcaggcgccagtgcggcgatagagtgatgttcggcatcgtcatagagaatcttgtcataaatttcatcggcgaagatgatgagattatgctcgcgcgcaatgttgacaatttccatcagcaattctttagaatagacggcgccagtagggttgtttggattaataatgacaataccacgcgtacgtggggtgattttggcgcggatatcgtcaaggtccgggaaccagtcggaagattcatcgcaaagataatgtaccgccttgccgctggagagcgataccgctgctgtccataacggataatcgggcgcgggaaccagcatttcatcgccactgttaagcaacgcctgcatcgcctgaacgatcagctcggaaacgccgttaccgatatagatatcttccacggttacatcgcgcattccacgggcctgataatgctgcataatcgctttacgggcggaataaagccctttcgagtcgcaatatccttgcgccgtcggcaaattacgaatgacatcgaccagaatttcgtccggcgcttcgaatccgaagggggcggggttgccgatattcagtttaagaactttattaccttcttcctcaaggcgtttcgcttctttcagaacggggccacgaatgtcataacagacattttcgagtttgctggatttttcaatgggggacatgaatcttgaccttttagctgttattgccactccctgccgtggaagtcagcacgaaacaatgtactcccacgacggtgagttttgaagagtgaacagaagaagattttgtttatttttaacgcgctttcgtactgtttaaaacttcataaaatcatttggttagatgcattttctatttttgtctgtatgtatagtgttttgttctatgtggttgcgcgtaatgtggttttttatgttgtcagaaattatctgttttatgagagataagcattcatcattagtgtcgcgtcggctatttcggaaatactgagtattaaaggtaaaatgagaaggttagacctttccggcggcgggtggtgtgaaactattgttaagtataattaatgaatggtagaaatcttaattaattattatttaatatttaaaaagcatttactaaagtcgtaataatatctttctggtcggattagtataacatatcccaggttaagattattcgtaataatacttataaatatagcggttttaggttaagataatgatccgaaacgggggcgtagtctgcgttgtctgctaattatcatgacgcgattttatacataacctattgttcaatatattgtttttgtatctgtgcgtctcggtaaactatttgacgctgttacaagatttacacgtccatcattagcagaaatctgtagacgcctaaaggtatgacacattctctttgatatatcccgatcagttgcatttggtattatatcagtaagtaagagaagtgttttggtcgtattttcaattacattctaacatttacctgggtaaccaggcggtactgcgaaggatgcacattacaaatggaattgcttgtttctgaatgcacagcattaaccaggtcagcccgatatgacccgtcagtaagtgaaaaattatgataaatgcaaatcgtccgataattaacctcgatctcgatctgctgagaacgttcgtggccgttgccgatctgaacaccttcgccgcggcggcggcggcggtatgtcgtactcagtctgcggtcagtcagcaaatgcagcgtcttgagcaactcgtgggaaaggaattgttcgcccgccatggtcgtaacaaacttttgagcgaacacggtatccagcttctggggtacgccagaaaaatcctgcgttttaatgatgaggcgtgttcatcattaatgttcagtaatcttcagggagtgttaacaatcggcgcttctgatgaatcagctgatactatcctgccttttttgcttagccgaatcagctcggtttatccgaaactcgcgcttgatgtacgggtaaaacgcaacgcctatatggtggacatggttaaatcgcaggaagtagatttggtggtgacgactaaccaacctcattcgctggactgtctgaatttgcggacctcgcccacccattggtattgtgcggctgagtatgttttgcaaaggggagagcccgtaccattagtcctgctggacgatcccagcccattccgcgatatggtgctggagacgctaaatgcagcgggtattccctggcggctggcctatgtggcctctacattactggcggtacgcgcggccgttaaagccggtcttggcgtaacggctcgacctgtcgaaatgatgagtcccgaccttcgcgtgctgggcgccgcagatggattaccgcctttgctggatacggaatatatgttgtgccgcgatcccaatagccagaacgagctggcgatggtgattttccatgcgatggaaagctatcaaaacccatggcattacaaccagttttctgcagagggcggagatgatccgctgatggtggaagggggttttgagtagctcgcaggcaaaaggcgctaagtcgtaaatgtaaaaaagagccgctggcgatgaaaaaacgctcagtggctctttttttgtgcccatctgtacgcgcttaaccgcacaaattgtaaaagttgcggtaaatcagccagtagcgattcgcagttcaatgtgggcaaaaaataaccagaacatccattttatgaatttgcatgttaaaaaactagagaaattgttgctgttttagggggtgaattaacaaaagcgtgtcacagatcaagaaaatactcccatttagggggaggcatcttcacaaattcctgtcaaaataggtgtgtgttatttcttttgcttcacaacggacacgattcaacaacataaaatctcccctggtcgaagagtcattttctccaggatggcacttaatgttaatgatgatgaattgatgtaaattaatgtgaaggaacttttgttaaagttgacaaaaggttatagaaaggagtaaaaaaccacatcaattagctgtttttatcattttctacagtaattgtagggtttttttattcctcccctgaatcgatgtggcgtccatctgccgtaaagagcagaggaactggcgctacttttgatgagtaagcaatgagtatgtcaacatccactgaagtcatcgctcatcactgggcattcgctatctttcttatcgttgccattggcctgtgctgcctgatgctggtaggcggttggtttttgggcggtcgcgcacgcgcgaggcacaagaacgttccgtttgaatcaggtatcgactcggtcggcaccgcccgcttacgcttgtctgccaagttttacctggtagccatgttcttcgttatcttcgacgttgaagcgctgtatctgttcgcatggtcaacttctatccgcgaaagcggctgggttggctttgtggaagctgcaatttttatttttgtgttactggctggtctggtttatctggcgcgtattggcgcgttggactggacgcccgcgcgttcacgccgcgagcgtatgaacccggaaacgaacagtatcgctaatcgtcaacgctaaccgcgaggcattaagatggattatacgctcacccgcatagatcctaacggtgagaatgaccgttaccccctgcaaaaacaggagatcgtaaccgaccccctggagcaggaagttaacaaaaacgtgttcatgggcaaactgcatgacatggttaactggggccgtaaaaactcaatttggccctacaacttcggcctttcttgctgctatgtagagatggtgacctcgtttaccgcagtgcatgacgttgcccgtttcggcgcggaagtgctgcgtgcgtcgccacgtcaggctgatctgatggtggtggccggtacctgctttaccaaaatggctccggttattcagcgtctgtatgaccaaatgctggagccaaaatgggtcatttctatgggcgcctgcgccaactccggcggcatgtacgatatttattcggtagtgcagggcgttgataagtttatcccggtggatgtgtatatccctggctgtccgccgcgtccggaagcgtatatgcaagcgttgatgctgctgcaagaatcgattggcaaagagcgccgtccgctctcatgggtggtgggcgatcagggcgtgtatcgcgccaatatgcagccagaacgcgaacgtaaacgcggcgagcgtattgccgtcacgaacctgcgtaccccggacgagatttaatttgcgcctgtcggcagcagcacttcacttcgctaaccactattttaatagcgcgaagcactgccgaccaccacggaccatttgcaatggtgaacaatatgaccgacttaaccgcgcaagacgctgcatggagtacccgcgatcatcttgatgatccggttatcggcgaactgcgcaaccgttttgggccggatgcctttaccgttcaggcgacccgcaccggtatccccgttgtttgggtcaagcgtgaacaactactggaggttggcgatttcttaaagaaactgccgaaaccttacgtcatgctgtttgacttacacggcatggatgaacgcctgcgtacgcaccgtgacgggttacccgccgcggatttttccgttttctaccacctgatttccattgagcgtaatcgcgatattatgctcaaggtggcgttgtctgaaaacgacctgcgcgtgccgaccttcactaaacttttccctaacgccaactggtacgagcgtgagacctgggagatgtttggcattgatatcgaaggccacccgcacctgacgcgcatcatgatgccgcaaacctgggaaggccatccgctgcgtaaagattatccggcgcgcgcgaccgaattcgacccgtttgagctgaccaaagccaagcaggatctggagatggaagcgttgacctttaagccggaagactgggggatgaagcgcgggactgacaacgaggactttatgttcctcaacctcggcccgaaccacccgtctgcgcacggtgcgtttcgtattatcctgcaacttgacggcgaagaaatcgtcgactgcgtgccggatatcggctatcaccaccgcggcgccgaaaaaatgggcgagcgccagtcctggcatagctacattccctataccgaccgtatcgaatacctcggtggttgcgtcaatgaaatgccgtacgtgctggcggtagaaaaactggcggggatcaccgtcccggatcgtgtgaacgtcatccgcgtgatgctctccgaactgttccgcattaacagtcatctgctgtacatttcgacctttattcaggacgtcggcgcgatgaccccggtcttctttgcctttaccgaccggcagaaaatttatgatctggtggaagccattaccggtttccgtatgcacccggcctggttccgtatcggcggcgtcgcgcacgacttgccgcgcggttgggatcgcctgctgcgagagttccttgagtggatgccgaagcgtctggactcttacgagaaagccgcgctgcgtaacaccattctgaaagggcgttcgcagggcgttgccgcttacggcgcgaaagaggcgctggagtggggcaccaccggcgcagggctgcgcgcgaccgggatagacttcgacgtgcgtaaatggcgtccatattctggctacgaaaactttgactttgaagtgccggtgggcggcggcgtttccgactgctatacccgcgtgatgctgaaagtggaagagctgcgccagagtctgcgcattcttcagcagtgcctcgataacatgccggaagggccgttcaaagcggatcacccgctgaccacgccgccgccgaaagagcgcacgctgcaacatatcgaaaccctgatcacccacttcctgcaggtctcctggggcccggtgatgccggcgcaggagtccttccagatggtggaagcgacgaaggggattaacagttactacctgaccagcgacggcagcactatgagctaccgtacccgcgtgcgcacgccgagctttgcgcacctgcagcagattccctcggcgatccgcggtagcctggtctccgacctgattgtctatctgggtagtatcgattttgttatgtcagatgtggaccgctaattatgcacgagaatcaacaaccacaaaccgaggcttttgagctgagtgcggcagagcgtgaagcgatagagcacgagaagcaccactacgaagacccgcgtgcggcgtccattgaagcgctgaaaatcgttcagaagcagcgtggctgggtgccggacggcgcgatctacgctattgccgatgtgctgggtattccggcgagcgacgtcgaaggcgtcgccacattctacagccagatcttccgtcagccggtcggtcgccacgtgattcgctactgcgacagcgtggtgtgccatatcaccggctatcaggggattcaggccgcgctggaaaaaaatctcaacatcaaaccggggcagacgacctttgatggccgctttacgctgctgccgacctgctgcctggggaattgcgataaagggccgaacatgatgattgatgaggatactcacagccatctgaccccggaagccattcctgaactactggagcggtataaatgaaaaacgttatccgtactcccgaaacccatccgctgacctggcgtctgcgcgatgacaaacagccggtctggctggatgaatatcgtagcaaaaacggctacgaaggcgcgcgtaaggcgctgaccggcctgtctccggatgaaatcgtcagccaggtaaaagacgctggtctgaaagggcgcggcggcgcgggcttttccaccggtctgaagtggagcctgatgccgaaagatgaatccatgaacatccgttacctgctgtgtaacgccgatgaaatggagccgggcacctataaagaccgtctgctgatggaacaactgccgcacctgctggtggaaggcatgctgatctccgcgttcgcgctgaaagcgtatcgtggttacatcttcctgcgcggcgaatatatcgaagcggctgtacatctgcgccgtgcgattgccgaagcaaccgaggccgggctgcttggcaaaaatatcatgggcaccgggttcgacttcgaactgtttgtccacaccggggcagggcgttacatctgtggtgaagaaacggcgctgattaactccctcgaaggccgccgcgcgaacccgcgctccaagccgcctttcccggcgacctccggcgtatggggcaagccgacctgtgtgaataacgtcgaaacgttgtgtaacgtcccggcaatcctcgccaacggcgtggagtggtaccagaacatctcgaaaagcaaagatgcgggtaccaagctgatgggcttctcgggccgcgtgaagaatccgggcctgtgggaattaccgttcggcaccatcgcgcgcgagatcctcgaagactacgccggcggtatgcgtgacggcctgaaattcaaagcctggcaaccgggcggcgcggggacagacttcctgaccgaagcacacctcgatctgccgatggaattcgaaagcatcggtaaagcggggagccgtctgggcaccgcgctggcgatggcggtagaccacgaaatcggcatggtgtcgctggtgcgtaacctggaagagttctttgcccgcgaatcctgcggctggtgtacgccatgccgcgacgggttgccgtggagcgtgaaaattctgcgcgcgctggagcgtggcgaaggccagccgggggatatcgagacgcttgagcaactgtgtcgattcctcgggccgggtaaaaccttctgcgcgcatgcgccgggcgcggttgagccactgcaaagcgcaattaagtatttccgcgaagaattcgaagctggcatcaagcagccgttcagtaatacccatttaatcaatggtattcagccgaacctgctcaaagagcgctggtgagttaacgatttttaatttggaagcatgctaatggctacgattcatgtagacggcaaagaatacgaggtcaacggcgcggacaacctgctacaggcatgtctgtccctcggccttgatattccgtatttttgttggcacccggcgctgggaagcgtcggtgcttgccgccagtgtgcggtgaagcaataccaaaacgcggaagatacgcgtggtcgcctggtgatgtcctgtatgacgccagccaccgacggtacctttatctctattgacgacgaagaagcgaaacagttccgtgaaagcgtggtggagtggctgatgactaaccacccgcacgactgtccggtctgtgaagagggcggtaactgccatcttcaggatatgaccgtgatgacgggtcacagtttccgccgctaccgtttcaccaaacgtacccaccgcaaccaggatctggggccgttcatctcgcacgaaatgaaccgctgcatcgcctgctaccgttgtgtacgttactacaaagattatgctgacggtaccgatctgggcgtctatggcgcgcatgacaacgtctacttcgggcgtccggaagacggtacgctggaaagcgaattctccggtaacctggtcgagatttgcccgaccggcgtcttcaccgataaaacgcactccgagcgttacaaccgtaaatgggacatgcagtttgcgccgagcatctgccagcagtgttccatcggctgtaacatcagcccgggcgagcgctatggcgaactgcgccgtatcgaaaaccgttacaacggtaccgttaaccattacttcctctgcgaccgcggtcgtttcggctatggctatgtgaacctgaaagaccgcccgcgtcagccggttcagcgtcgtggcgatgactttattactctcaacgccgagcaggcgatgcagggcgcggcggatattctgcgccagtcgaagaaagtgatcggtatcggttcgccacgcgccagcattgagagcaactttgcgctgcgtgagctggttggtgcggaaaacttctacaccggtatcgcgcgcggcgagcaggaacgtctgcaactggcgctgaaagtgctgcgtgaaggcggaatttacaccccggcgctgcgggagatcgaatcttatgacgcggtactggtcttgggtgaggatgtcactcagaccggcgcgcgcgttgcgctggcggtacgccaggcggtgaaaggtaaagcgcgtgaaatggcggcggcgcagaaagtggccgactggcagattgcggccatccttaacatcggccagcgtgccaaacatccgctgttcgtgactaacgtggacgacacccgtctggatgatatcgccgcctggacttatcgcgcgccggtggaagatcaggcgcgcctgggctttgcgattgctcatgcgctggacaatacagcgcctgcggttgacggtatcgacagcgacttgcaaaacaaaattgatgtcattgtgcaggcgttggccggcgcgaaaaaaccgctgattatctccggcactaacgccggtagcagtgaggtgattcaggcggccgccaacgtggcgaaagcgctgaaaggccgtggcgccgacgtcggtattactatgattgcccgctccgtgaacagcatggggctgggtatgatgggcggcggttcgcttgacgatgcgttgggcgagctggaaaccggcagcgcggacgcggtggtggtgctggaaaacgatctccaccgtcatgcaagcgctacgcgcgtgaacgccgcgctcgccaaagcgccgctggtgatggtggttgaccatcagcgcacggcgattatggaaaatgctcatctggtgctttccgcggcaagcttcgccgaaagcgatggtacggtcatcaacaacgaaggccgcgcgcagcgcttcttccaggtttatgacccggcctactacgataacaagacgattatgctggaaagctggcgctggctgcattcgctgcacagcaccgtcgaaaaccgcgaagtggactggacacagcttgaccatgtgatcgacgcggtcattgccgccatgccgcaatttgccggcattaaggacgccgcgccggatgcgaccttccgcattcgtgggcagaagctggcgcgcgaaccgcatcgttacagcggtcgtacggcgatgcgcgccaatatcagcgtgcatgaaccacgtcagccgcaggataaagacaccatgttcgccttctcaatggaagggaataaccaaccgactgccccgcgatctgaaattccgttcgcctgggcgccgggctggaactctccgcaggcgtggaacaaattccaggatgaagtgggcggcaaactgcgtcacggcgatccgggcgtgcgtttgattgaagcgactgagggcggtctggattatttcactaccgtgccggcaagcttccaggcgcaggacggtcagtggcgtattgcgccgtattaccacctgtttggcagcgacgaattgtctcagcgttctccggtcttccagagccgtatgccgcagccgtatatcaaacttaacccggcggatgctgcgaagttgggcgtcaatgccgggactcgcgtctcctttagctacgatggcaatacggtgacgctgccggttgaaatctctgaagggttagcggcagggcaggtagggctgccgatgggtatgcctggcatcgcgccggttctggctggcgcgcgtcttgaggatctgcgggaggcgcaacaatgagttggattacaccggatctgattgagatcctgctgagcattctcaaagcggtggtgattctgctggtggtcgtcacctgcggggccttcatgagctttggcgaacgtcgtctgctgggtctgttccagaaccgttatggaccaaaccgcgttggctggggcggttcgctccagctggtcgcggatatgatcaagatgttctttaaagaagactggatcccgaaattctcggatcgcgtcatctttaccctggcgccgatgatcgcgtttacttcgctgctgctctccttcgccattgtgccggttagccctaactgggtggtggccgatttaaacatcgggattttgttctccctgatgatggccggtctggcggtttacgcggtactgttcgccggttggtcgagcaacaacaaatactcgctgctgggcgcgatgcgcgcgtctgcccagacggtgagctacgaagtgttccttggtctttccctgatgggcgtggtggcgcaggccggttcatttaatatgaccgatatcgtcaataaccaggcgcatctgtggaacgtgattccgcaattctttgggtttgttactttcgccatcgcgggcgtagcggtctgtcaccgtcacccgtttgaccagccggaagccgagcaggaactggcggacggttaccacatcgaatattccggtatgaaattcggtctgttcttcgtgggggagtacatcggcatcgtcaccgtttccgcgctgatggtaacgttgttcttcggtggctggcatggcccgttcttaccgccattcgtctggttcgcgctgaaaaccgcgttcttcatgatgatgttcattttgattcgtgcgtcgttaccgcgtccgcgttatgaccaggtaatgtccttcggctggaaagtttgcctgccgctgacgctcatcaacttgctggtaacggcggctgtcattctgtggcaggcgcaataagggacacaaagaccatgaccttaaaagaattattagtaggtttcggcactcaggtacgcagtatctggatgatcggcctgcatgcgttcgcgaaacgcgaaacgcggatgtatccggaagagccggtctatttaccgccccgttaccgtggccgtatcgtgctcacgcgcgacccggacggtgaagagcgctgcgttgcctgtaacctgtgcgcggtagcctgtccggtaggctgtatctctctgcaaaaagcggagaccaaagatggccgctggtatccggaatttttccgcattaacttctcacgctgcatcttctgcggcctgtgcgaagaagcgtgcccgaccacggcgattcagttgaccccggacttcgaactgggcgaatacaaacgtcaggatctggtgtacgaaaaagaggatctgctgatttccggtccgggcaaatacccggaatataacttctaccggatggcgggtatggcaatcgacggcaaagataaaggcgaagcagagaacgaagccaagcctatcgacgtcaagagcctgttaccgtaaggagagggcaatggaattcgctttttatatctgtggcctgatagccatcctcgcgaccctgcgagtgatcacccataccaatccggtacacgcgctgttgtatctggtgatatcgctactggcgatttccggggtgttcttttcgctgggcgcttactttgccggtgcgctggaaattatcgtctacgcgggtgccattatggtgctgtttgtgttcgtggtgatgatgctcaacctcggcggcagcgaaatcgaacaggaacgccagtggctgaagccgcaggtgtggattggtccggcggttttgtcggccattatgctggcggttattgtgtacgccattctgggcgttaacgaccagggcatcgacggcacgccgattagcgcgaaagcggtgggcattacgctgttcgggccttatgttctggcggtcgaactggcgtctatgctgctgctggcaggcctggtggtggcgttccacgtcggtcgtgaagagcgtgcgggcgaagtgctaagcaaccgcgccgatgaccgcgcgaaaagaaaaacggaggagcgcgcatgatccccttaacacacggactgatcctcgctgcgattttattcgtcctgggtttaaccggtctggttatccgccgcaatctgctgtttatgctgatcgggctggaaatcatgattaacgcctccgcgctggcctttgtggtcgccgggagctactggggccagaccgatggtcaggtgatgtacattctcgccatcagccttgcggctgcggaagcgagtattggacttgcgctgttgctgcaactccatcgccgtcgccagaacctgaacatcgattcagtaagtgagatgcgtggatgaacatgcttgccttaaccattattctgccattgattggctttgtactgctggcgttctctcgcggacgctggtcggaaaatctctccgcgaccattggcgtgggctccgttggtctggcggcgttggtgacagcgtttgtcgggatggatttcttcgccaacggcaaacaggcgttcagccagccgctgtggacgtggatgtcggtcggtaacttcaacatcggttttaacctggtgctggacggcctgtcgctgaccatgctctctgtggtcaccggcgtcggcttcctgatccacatgttcgcttcctggtacatgcgtggagaagagggctactcccgcttcttcgcttataccaacctgtttatcgccagcatggttgttctggtgctgtccgataacctgctgttgatgtacctcggctgggaaggcgtgggcctgtgctcttatctgttgatcggcttctattacagcgatccgaagaatggcgcggcggcaatgaaagccttcgtggtgacccgtgtcggtgacgtattcctcgccttcgcgctgttcatcctctacaacgaactgggcacgctgaacttccgcgaaatggtcgagctggcgccagcgcactttgctgacggcaacaacatgctgatgtgggcgacgctgatgctgctgggcggcgcggtcggtaaatctgcgcagctaccgttgcagacctggcttgccgacgcgatggccggtccgacgccggtctccgcgctgatccacgccgccaccatggttaccgccggtgtctacctgatcgcacgcacgcatggcctgttcctgatgaccccggaaattctgcatctggtgggcattatcggggcgattacgctggtcatggcgggtttcgccgcgctggtgcagaccgacatcaaacgcgtgctggcctattccaccatgagccagattggctacatgttcctggcgcttggcgtgcaggcgtgggatgcggcgattttccacctgatgacgcacgccttctttaaagcgctgctgttcctggcatccggctcggtaattttggcctgccatcacgaacagaacatctttaagatgggcggtctgcgtaagtccattccactggtgtatgcctgcttcctggtggggggcgcggcgctgtcggcgctgccgctggtcactgcgggcttcttcagtaaggatgagatcctggctggcgcgatggcgaacggtcatatcaatctgatggtggcgggtctggttggcgcgttcatgacctccctgtacaccttccggatgattttcatcgtattccacggtaaagaacaaattcatgctcatgcagggaaggggattacccaccatctgccgctgattgtcctgatgattctgtctacctttgttggcgcgctgattgtgccgcctctgcagggggtgctgccgcagacaactgaactggcgcatggtcgtgtgttgaccctggaaattacctctggcgtagtggcgattgccggcatcctgattgccgcatggctgtggctgggtaaacgtacgctggtgacgtcgatcgccaacagcgcgccgggccatctgctggggacctggtggtataacgcctggggctttgactggctgtacgacaaagtattcgtcaagccattcctcggtatcgcctggctgctgaagcgcgacccgcttaatgcgttgatgaacattccggctatcctttcccgttttgcaggcaaaggcctggtactgagcgagaacggttatttgcgctggtatgtggcatccatgagcatcggcgcggttgtggtgctggcgctgctgatggtactgcgttgagtttgttggctggatgaacgactgccggatggcgcagtgcttatccggcctacaaacccaaaaataatttttagaattcgttgaaaatctgttcctgaagtacaggcgtcatcggcgaagtcagaccggataccgccagcgcacagcaaccggagcgtactgaagtacgtgaggatgattcgcgaagctcacccctacggggccgtccttacggacgttcaaaacgcgctgcgttttgtgtgagcactggcaggatttgggctgacgagtgagatagcctgagcaggagtaaatataagggacatacttagctatgttattaccctggttgatattaatcccctttatcggcggctttctgtgctggcagaccgaacgctttggcgtgaaagtgccgcgctggatagcgctgattaccatggaactgacgctggcgctcggtctgcaattgtggttgcagggcggctactcactgacgcaatccgccggtattccacagtggcaatctgaatttgtcctgccgtggattccgcgttttggcatctctatccatctggcgctcgacggactgtcgctgctaatggtggtgctgaccggcctgctcggcgttctggcggtgctttgctcttggcgagaaatcgaaaaatatcagggcttcttccacctcaacctgatgtggatcttaggcggcgttatcggcgtgttcctggccatcgacatgttcctgttcttcttcttctgggaaatgatgctggtgccgatgtacttcctgatagcgctgtggggccacaaagcttctgacggtaaaacgcgtatcacggcggcaaccaagttcttcatttacacccaggcgagtggtctggtgatgttgattgccatcctggcgctggtgtttgtgcactataaagcgaccagcgtgtggaccttcaactatgaagagctgctgaataccccgatgtcccacggtgtggaatatctgctgatgctgggcttcttcatcgccttcgcggtgaaaatgccggtggttccgctgcatggctggctgccggatgcgcactcccaggcgccgaccgccggttccgtcgacctggcggggatcttgctgaaaaccgccgcttacggtctgctgcgtttctccctgccattgttcccgaacgcgtcggcggagtttgcgcccatcgccatgtggctgggcgtcatcggcattttctacggcgcgtggatggcctttacccaatacgacatcaagcgcctgattgcctatacctccgtttcccacatgggcttcgtgctgatcgctatctacaccggcagtcagctggcgtaccagggcgcggtgattcagatgattgcacacggtttgtccgcagccggtctgttcattctgtgtggccagttgtacgaacgtctgcatacgcgtgacatgcgtatgatgggcggcctgtggggcaagatgaagtggttgcctgcgctgtccatgttctttgcggtggcgacgctcggtatgccgggcaccggtaactttgtcggcgaatttatgattctgttcggcagctatcaggtggtgccgatgattaccgttatctcgacctttgggctggtattcgcctctgtatactcgctggcgatgctgcatcgcgcttactttggtaaagcgaagagccagattgccagccaggaactgctagggatgtcgctgcgcgagctgtttatcattctgttgctggtggtgcttctggtactgcttggcttctatccgcagccgattctggatacctcgcattctgcgatgagcaacatccagcagtggtttgttaattccgttactactacaaggccgtaaatcgccatgacaataactccacaacacctgattgcgctgctaccgctgctgatcgtcggcttgacggtggtggttgtgatgctctccattgcgtggcgacgcaatcacttcctcaatgccacgctgtcggtcattgggcttaacgctgctctggtttcgctttggtttgtcggccaggccggggcaatggacgtcacgccgctgatgcgcgttgacggctttgcgatgctctacaccgggctggtgctgctggcgagcctcgccacctgtacttttgcctacccgtggctggaaggctataacgataaccaggaagagttctacctgctggtgttaatcgccagcctggggggaattctgctggcgaacgccaaccatctggcggcgctgttcctcggtattgaactgatctcactgccgctgttcggcctgattggttatgctttccgccagaaacgctcgctggaagccagtatcaaatacaccatcctctccgccgccgcctcgtctttcctgctgttcgggatggcgctggtctatgcgcagtccggcaacctgtctttcgaagcgctcggtaagagcctcggcgatggtatgctgcacgagccgttgctgctggcgggctttggcctgatgattgtcggtctgggctttaaactctctctggtgccgttccacctgtggacgccagacgtttaccagggcgcgcctgcgccggtttctaccttcctggcgacggcgagcaaaatcgctatcttcggcgtggtaatgcgtctgttcctgtatgcgccggtaggcgacagcgaagcggtacgcgtggtgctgggcattatcgcctttgcctctatcatcttcggtaacctgatggcgctgagccagaccaacatcaaacgtctgctcggttactcttctatctctcacctcggctatctgctggtggcgctgattgccctgcagagcggcgagatgtcgatggaagcggtaggcgtttatctggccggttatctgttcagcagcctcggcgcgtttggcgtggtcagcctgatgtccagcccgttccgcggcccggatgccgactccctgtactcttaccgtggtctgttctggcaccgtccggttcttgccgcggtgatgacggtgatgatgctgtcgctggcaggtatcccaatgacgctgggctttatcggcaaattctacgtgctggcggtcggcgttcaggccagcctgtggtggctggtcgccgccgtggtggtgggttccgcgattggtttgtactactacctgcgcgttgcggtgagtctctacctgcacgcgccgcagcaaccgggacgcgacgcgccgacaaactggcagtacagcgcaggcggtatcgtggtgctgatctccgcgttgctggtgttggtactgggcgtctggccgcagccgctgattagccttgtgcagttagcgacgccgttgatgtaagcaataagtaaaaacgaaaaacccgcttcacgaagcgggttttttattacctgatgtcattctttaaaatgactcaggacggtagaccggataaggcgtttgcgccgccatccggcctgtaaggtctcagcgaccggaatttaacttagcaactgccggcttaccagcgggccgctgatgttttgcgccgcgcgttccatcacttcctgtatcactgaagagagttcgttaatctcaaacttggccacgtagccgtcggctttcaccttacgcacatgatcttcgttggcgctgccggaaagggaagagtgaataacaaccgggatctttttcagccgttcatcggttttaattttacgcgttaacgtaaagccatccatctccggcatctcaaggtctgtcaggactagcgcgattttctcgctaattggcttaccttcggcctccgcttcctgcgccagttgctggattctctcccaggcatccttgccggtcacatgcatctgatgcggaatttccatcgcgttcagccctttttccagcatcgcgcaggcgactttggagtcttccgccacaatggcaaccgcgccgggggtaatataaaatttattggtcttcagattggtggcgcgcagatcgtggctggaggggacaatatcataaaggatctgctcaacgtcgagcaccagcgccaggttgttggtttctttgttgtcatccaggcaggcaatactggtgatgtagcgaccgttgacggctttctcggcggtatgcacctgttgccagtcaagacgcataatattttccaccgactcgacggcaaatgcctgtacgctgcgcacatattcggtgatcagcaaaatattcagcccggtttccggcttgcagcccgctaccgctggcaaatcaatcaccggaatgacctgatcccgaatattgaccatgcccaatagcggcgctttcatgcctgccgggcgcgtaaaggcgggcataggtatgatttcgcgcagcttaaatacattgataccgaacagctctgacttctgttcatgcagcgatgtaccaagacggaataacagcagttcaaaacggttggacagggttaaattggccctgtcatcaatatctttctgaaaattgtccatcctaacctcattatgaaagcctgccttttttagtgttatcggcaatgaggacaaaaaatggagcgctaaaccgggaaaacagaaaaatcgtaagccagctccgtcgccgggaaaatagcgcggcattccgccagtaagcgctgacagcctttatcgtcatagcgtgagctaatgtgggtcatgatcagccgaccaacggcagcctcccgcgccagcgtcgcggtttgacgggtggagctgtgtccgcgagcgttggctttctcctccattgacgcatccagcgtggtttcatgaaccatcacatccacaccctgcgccagtgcgagggcggcctcgcagggcgcggtatcgccgaaaatcgccactgatttcccggccacggcgggagcaaggtagtcggcgccattgatctgccttccatcggcaagcgtgacggtttttcctgccttcaacgcctgaaacagcgggccgggcgtaacgcctgcggcttttaacgccctggcattcagcgcgccaggcttgtcatgttcaacaacgcgatatccgtagcactccagtggatgctccagcctgaatgcggtcactttacgcagaccgtcgtcaagaatatcgccagcgctaatttcttcaatttgcaacggaaaatcggtccatgaaccgctaaggcgcagtgtggttgcaataaactcacgcacgccttgaggcccgtatacggttagcggatggggattccccgccatcgaccggctgcatagcagacccggcaggccaaacagatgatcgccgtgaagatggctgataaaaatgcgctcaagcttaccgggatgaaacgcggtattaagcatttgatgctgtgtcccttcgccgcaatcaaaaagccatactcccggctgcgttggatgttgcagatgtaataaaattgccgttacattgcgtgagcgtgtgggaacgcctgcggacgtacctaaaaaaattaattccatcttgtccatacgcgtttggttatcgtttaacccaagattaccacaacacaggagcgcatcatgattgactggcaggatctccaccatagcgaacttactgttcctcaactttacgcgttactcaaattgcgctgcgcggtctttgtggtagaacagcgctgtccttacctggatgtggatggcgatgatttagtcggcgacaatcggcatattctgggctggcatcaggatgagctggtggcgtatgcgaggattctgaaaagtgataacgaatcagacccggttgtcattggccgggtgatcgtcagcgatgcctggcgaggggcgaaactgggccagcaattaatggcgaaaacgctggaatcttgtgggcggcactggccggataagccgctatatctgggggcgcaggcgcatctgcaacctttttatgcgcggtttggttttattcccgtcaccgatgtttatgacgaagacggcattccgcaccggggaatggcgcgggaggttcatcaggcataaaccgaaaccgttgactatagttaggagcaggtgttaacacaacggagaatgagaatgtcatatcaatttggtgaatcacgtgttgatgatgatctgactttgctcagcgaaacgctggaagaggttttacgttcctcaggcgatcccgccgatcaaaaatacattgagctgaaagcccgcgcggaacaagcgctggaagaggtgaaaaaccgcgtaagccatgcgtcggatagctattattaccgggcaaagcaggccgtttataaagcggatgactacgttcatgaaaaaccctggcagggtattggcgtaggcgcggcggtaggactggtgcttggactgctgctggcgcggcgctaaatccccccactgaacagaattgcaaccctccctaaatgaggtactgcttttttagggcagtaccccgtataatgtggggtttttaacagggaggggccgcgtgcattctattactactgcgctggaaaatctgacgcgtcagctatcgcaagagataccggcgacgccagggctttgcgttttcgatgcgcctttccctttaaacgatgccttcgatgcattgagctggctggccagccagtcatcctttccgcaattctactggcaacagcgcaatggcgacgaagaagctgccgttctcggggccatcaccgtcttttcatcgctcgatctggcgcaacggtttttacgtcagcacgcgcagcctgacctgcgtatttgggggctgaatgcgttcgagccgaaagagggctacttattgctgccgaggctggagtggcgacgtagcggtggtacggcgaccttacgcttacatctgcacagtgacgtttcgctacgcgatgatgcgcgcctggcgaaagcgtttctcgcttctctggtcggtattaagcctgttccggcgctgcgcctttcgctcacgagcgaacaacactggccggacaaagacggttgggtgaagctgattcagcaggccacccacactattgcgcaagaggcgtttgataaagttgtgctggcgcgggccaccgacttacaattctcccgtccggtcaatgccgccgcgatgatggcgtccagtcgtcgtttaaatctcaactgctaccacttttttatggccttttccgccgataccgcctttctgggatcatcgccggagcggctctggcggcgtcgtgaaacggcgctgcgtaccgaagcgctggccgggacggtggcgaaccatccggataaccataaagcctggcagcttggcgaatggttaatgaaagacgataaaaaccagcgagaaaatatgctggttgtcgaagacatctgccagcgactgcaaaactgcacccactcgctggatgtgctgccgccgcaggtgctcagactgcgcaaggtacagcatttgcgccgctgtatctggacggcgcttaatcaggcggacgacacgctctgcctgcaccagttacagcctaccgcagcggtcgccgggatccctcgtgaacccgcgcgttgttttatagaacaacatgagccgttcgaacgtgaatggtatgccgggtcggcaggctatctctccacgcggcaaagtgagttttgcgtgacgttacgttcagccaaagtgacggccaatgtggtgcggttgtatgccggcgcgggaatcgtccgcggctccgatccggaacaggaatggcaggaaatagataataaagcggccgggttacgtaccttattgcagatggacgcgtaatgagtcacatattcccgacccatatcaataatccatttttgcagctctttatacttagtcccaatgattgataccggacaaactcatgtcagtaagtgcatttaaccggcgctgggcggcggtcatcctggaagccttaacccgtcatggcgtcaggcatgtttgtatcgctcctggttcccgttccacgccgctcacgttggcggcggcagagaatcctgcttttattcaccatacgcactttgatgagcgtgggcttggtcatttggcgttagggctggcgaaagtcagccaacagccggttgccgttattgtcacttcaggtaccgccgtggcgaacctctatccggcgctgattgaggcgggtctgacgggcgagaagctcattttacttaccgccgatcgcccgccggagttgattgactgcggcgccaaccaggcgatccgtcaggcggggatgtttgcctcgcacccctcccaaactctgtcgttgccgcgtcccacgcaggatattccggcgcgctggctggtgtcgaccatcgacaatgcgctcgccatgcttcatgcgggcgcgctgcacattaactgtccttttgccgaaccgctgtatggcgatatgaatgacaccggtctggtctggcagcagcgtctcggcgactggtggcaggatgaaaaaccctggctgcgcgaagcgcgtcgactggcaagcgacaaacagcgcgactggttcttctggcgacaaaaacgcggtgtcgttgtcgccgggcgtatgagcgcggaagaaggcaaaaaagtggcgcagtgggcgcaaactctgggatggccattaattggcgacgtattgtcgcaaaccgggcagccgctgccgtgcgccgacctgtggctcggcaacgccaaagcggtgaccgaactgcagcaggcgcagattgtcgtccagcttggcagtagccttaccggaaaacgcttactgcaatggcaggcaacctgcgtgccggaagagtactgggtaatcgacaatattgaaggtcgtctggacccggcgcaccatcgtggacgcagactggtagcgaaaatcgccgattggctggaactgcatccggcggaaaaacgtaaaccgtggtgtgtagagatcccgcgtctggcggaactggcgtggcaacgggtggtcgcgcagcgagacacctttggcgaagcgcagctggcgcaccgtatccgcgactatctgccggagcaggggcaattgttcgtgggcaatagtctggtggtgcgtctgatcgacgcgctgtcacagttgccggccggctatccggtatacagcaatcgcggggcgagcggcattgacggcctgcttttcacagcggcgggcgtgcagcgcgccagcgccaaatcgacgttggctatcgtcggtgatttatccgcgctgtacgatcttaacgcgctggcgttactacgtcaggtatccgcgccgtttgtgttgattgtggtcaacaataacggcgggcagatcttttccctgctgccgacgccgcaaagtaagcgtgagcgcttttatctgatgccgcaaaacgtccattttgaccatgcggccgccatgtttaacctgcgctatcatcgcccggaaaactgggaagaactggagtctgcgctggctggcgcgtggcgaaccccggcgacaacggtgattgagctggtggtaaacgatacggatggcgcgcagacgctgcagcaacttttggctcaggtaagccatctatgatgttgcacgcgcagcacatgcccggacagcctgggacgccctcgctggttttcctgcacggtttttctggcgattgccgcgaatggcagccggttggcgaacagtttcacggctgttcgcggctttatattgacttaccaggacatggcggatctgcggctattccggtcggcggctttgccgatgtcatcagattactgcgcgccacgttaattagttacaacatactaaagttttggttggtgggatactcccttggcggccgtgtggcgatgatggcagcctgccagggaatacccggcctgtgcggcctggtggtcgaaggcggtcatccggggctgcaaaatgaacaggcgcgcgctgaaagacgattgtccgacgggcgctgggcagagcgttttcgtcatgaacccttgactgaggtttttcacgactggtatcagcagccggtgttcgcctcgctgacggcgcagcaaaggcaggcgctaacggcgctgcgtagccagaataacggcgaaacgctggctgcgatgctggaggcgacatcgcttgccgtccagccggatttacgcgaggtgcttaacgcgctggcatttccgttttattatttatgtggcgaacgcgacagcaaattccgcgccctggcgcaggaagtggcggcgacatgccatgtcattcgtaacgccggacacaacgcgcaccgggaaaaccccgctggcgtggtagacagtctggctcagattctgcgtctctgactaaaggacacactatgatctatcctgatgaaacaatgctttacgcaccggtagaatggcacgactgctcggagggttacaccgacattcgttatgaaaaatccaccgacggtattgcaaaaatcaccattaatcgtccgcaggtgcgcaatgcatttcgtccgttgaccgtcaaagagatgattcaggcgctggcggatgcccgttacgacgacaacgtgggcgtgattattctgaccggcgaaggcgataaagcgttttgcgcgggcggcgaccagaaggtgcgcggcgattacggcggttatcaggatgactccggcgtgcatcacctgaatgtgctggacttccagcgccagattcgcacctgtccaaaaccggttgtcgcgatggtcgcgggttactccatcggcggtggtcatgtgctgcacatgatgtgcgacctgaccatcgcggccgaaaacgccatcttcggccagaccggtccgaaagtcggctcctttgacggcggctggggcgcttcgtatatggcgcgtatcgttggtcagaagaaagcgcgtgaaatctggttcctgtgccgccagtacgatgcgcaacaggcgctggatatggggctggttaacaccgtcgttccgctggcggatctggaaaaagagaccgtgcgctggtgccgcgaaatgttgcaaaacagtccgatggcgctgcgttgcctgaaagcggcgctgaatgctgattgtgacggtcaggccgggctgcaggagctggccggcaacgctaccatgctgttctacatgacggaagaagggcaggaaggccgtaacgcctttaaccagaagcgtcagcctgatttcagcaaattcaaacggaacccataatgcgtagcgcgcaggtataccgctggcagatccccatggacgcgggggtggttctgcgcgacaggcggttaaaaactcgcgacgggctgtatgtttgtctgcgtgacggcgagcgtgaagggtggggagagatctccccgctgccgggcttcagtcaggaaacgtgggaagaggcgcagacggcgctcctgacatgggtgaatgactggcttcaggggagcgagggattaccggagatgccttcggtcgcgtttggcgcaagctgcgcgctggcggaactgactggcgtcttgccggaggcggcggactatcgcgccgcgccgttatgcactggcgatcctgacgatttggtactgcggcttgccgatatgcccggcgagaaaatcgctaaggtcaaagtgggtctctatgaagcggtacgcgacggcatggtggttaatttgctgctggaggcgatcccggatctgcatctgcgtctggatgcgaatcgcgcctggacgccgctaaaagcccaacagttcgcaaagtatgttaatccggattaccgcgctcgtatcgcctttctcgaagaaccgtgtaagacgcgggatgattcccgcgcctttgcccgtgaaaccggcatcgcgattgcctgggacgaaagtctgcgcgaagcggatttcacctttgaagccgaagagggcgtcagggctgtggttatcaaacctacgctgaccggatcgcttgataaagtgcgtgagcaagtcgctgccgcccatgcgttgggactgacggcggtcatcagctcttcgatcgagtccagcctcggcctgacgcaactggcgcggattgccgcctggttgacgccgggaacgctgcccggactggataccttgcatctgatgcaggcgcaacaggttcgcccctggcctggtaacgcgttgccttgtctgaagcgtgatgagctggaacgactgttatgacattcacggactggccgtggcgccactggcgtcaggttcgcagtcaggcgcccgctctgcgcctgaacgatgaagtgctaagctggcgcgccctctgtgagcgtattgatgcgctggcgggcgggtttgccgcgcagggcgtacgggagggcgacggtgtcctgctgcgcgccgggaatcagccgcgcactctgttggcatggcttgcgctgatgcagtgcggcgcgcgggttctgcccgtcaacccgcagttgccccagacgttgctggaggcgctggtgccgaagttaacgctgcgttttgcgctgacactggaaggcgaaaacgcgttttccggattaaccgtgttgcagttgcggaaaagtacagtggcgtatgctgtggcctggcaaccgcagcgtctggtttccatgacgctgacatcgggttccacaggattgccaaaagcggctgtacatacgtgccaggcgcatcttgccagcgcgcagggggtgctttcgctaatgccgtttggccctcaggatgactggctgctatcgctgccgctgtttcatgtatccgggcagggtattatgtggcgttggctcttcgccggggcgcgcatgacggtacgcgataagcaaccgctggagcagatgctggcaggttgtactcatgcttcgttggtgccgacgcagctgtggcggctgttggcgaatcgggcggcggtgacgctgaaagccgttttgctcggcggcgcggtgattccggttgaactcaccgaccaggccagcaaacaagggattcgctgctggtgcgggtatgggctcacggagttcgcgtctacggtatgcgccaaagaggccgatggttcggatgatgtgggcgcgccgctttccggcagagagatcagaatcgtcgataatgaagtctggctgcgcgccgccagtatggcggaaggttactggcgtgatggcaaactgatcccgctggttaatgacgaaggctggtttgccacgcgcgatcgcggcgagctgaaccacggtaggctaaccatcgccgggcggctggacaacttgttctttagcggcggcgaaggcattcagccggaggaagtcgaacgcgttattaacgcgcatccgctggtgcaacaagcctttgtcgtgccggtagaagataaagagtttggccatcgtcccgttgcggttgtggagtatgcatcgcaggccggagacgtgaacctcgctgaatgggttcgcgataagctggcgcgttttcaacagccggttcgctggttgacgctgccgtcagaactgaaaaacggagggattaaaatatctcgccgtgcgctccagcagtgggtgtgtaagatctgtaaaaattaatgttaggttaatatacaaccattccatcgctattgccgttttgtttatccgttgatgtgtaacgtgttatgaacaatcagcgtgaaacgggggcgctatggaatggttggttaagaaatcgcattatgtcaaaaagagggcgtgccatgttctggtgctgtgcgatagcggcggttcgctaaaaatgatcgccgaggcgaattccatgatattactgagtcccggcgatatcctgtcgcctttacaggatgcgcagtattgtattaatcgggaaaaacaccagaccttaaaaatcgttgatgcacgctgttattcctgcgacgaatggcagcggttgacgcgcaagccattatgatctggcgggcagaaaaatcagcattacccccgccataatgcacaatacgccgagcatcgcttttaggctgaaagcgccttgcaaaccgggtaacaacattgaggctacccagacaagcacataactgagactcagcagcgcataggctttgctgagcgcgagcatgtgtaatgttttctgccagcagaagacggaaaccagatatcccgccaaaccggcgaatagcgccagggtcgcggcattaaatgcgcccagcccggaaataaacgccagtggatgcgctatcgatggcagtcgcatcatggcgaatcctaaactcaactgggcgagggaggcaatcgcaacgcttatcagtccccacattacgcccattatgccgcactccccagaatgataatgccgctgataattaatgcgacgcccaaccagtggcggggcagaacctgttcatgccagattttccaggccgccagcgtgacccagacaaaattcagattcaacatcgggtaagcaattcccaccggcagggtttgtagcaccagcagccacagcaccatcgctgcacccatgcatatcagcgccaggcccagccacagcatcaagtgacggcggcgtccgctcgtcgtcaatggccgtgtcgcttgcttctggcagagctgaccgtcaacgctgagcagactggcaagcaccagaacgatgccgatcatttaggccgatactgaattaacaccagacgcccctgataatcaacattgtccgcagggggaagggaaagtgcgctgatgtcttcgtctttgtctattgaaagtactagcgtaataatgccctcctgacgatgttggttgagccaggcgttaaaatcgtcggctttaacgaatttattctgtacatcaggatagctaagaccatacctgagttcgcccgcgtgtccgtagagcataatatcgtctcgtttcagactccaggccagcccggcggcgacgcccacgctgtcggcaagaatatagcggcttgatgccaaaggcgcctgggtcatttcgacaaaaaactgtggctgtttggactccatcaccctgtcggggacggaaaagccgaacagcagcgccagtcccagcggacaaaacgcgggtaataggtattttgggctatgacagaggctataccagcccacaaacgcccaaacagtaaagacgccccagacgcaaaacactttataggtttcgatatgcgtccacaccggcgatttcagcgggccccatgaggagacgacaaacgccgcgacgatcccgattatcccgaacaccaggttgatcccgccgttgacacgtagcgcggcgacgccttcttttacgttatgcaggacgaagcgcgccatgagtatcgctatcggtgcgaaacaggaaagaacataggtgggcagtttccctttcgcaatgctgaaaaagagaagcggcatgatcgtccatccgagcaaatagaatgcgccgtttcgctcgcgccagcccagtttaagcgcgccaggcagtaaccccagccacggtaaacttcccgcgagcagcaccggcagatagtaccagaaaggggctttatgctgggcatcgctcatggcgaatcgctggatatgctccacccagaaaaagtaatgccagaaatcggcttcgcgtcgcgcaatggcgatcgcccagggaaggacaaccacaaagcagctcaagaccgccagccagccgtaaagcaaaaagtccttccagcgtttctgaacaataacccacggcagcacgctcaccaccggtacggccagggcgaggaaccctttagttaatacacccagaccgcaggttgcgcccagtagcaaaaacatcccaatcttgcccgttcgggtcgtggcctgcatcccctgccagaaacaacacatcccggccgtaagccaaagcgcgatcatcgggtcgagtaccgcatacgtcccgatactgtaaacggcaaagagggagagaaagatcacggaggcgagcaacgcggtacgtttatcccgccataagcggaacgtcagccacgccaccagcgctgcggccagcaatgtcgttaaaatagcgccggcccgcacgccaaaattggtagcgccaaaaagccactgacccagactgtttatccagtaaccggctatcggtttttcaaaataacgtaatcccagaaaatgcggcacgatccagtcgccagacgccagcatctcccgacttatttcggcatagcgcgtttcatccggctgccagagcaggcggctgttgacaggaataacatagtagagcgcgataaacgcggcgaaagccagataatagcgtatcgatttcatcatgaggcgctcactgcctgttgacaccccagccaaccttcacggccagggatgtgtccacgtacaatttgccccaacggcagagactcaggcgatgccggcagcagttcgcccagaggacaaaaggtgatccccgcatcgcgtgcacgaacgagcaaatcttcaaacagcggctgatggacaataccttcgacttccgcatggatggtatataccggcgtgcctttgtcctgcaacatacgggaaataatccaggtattgaacgactgcgcctgaacggcggggccgataacctcatcccacgtgggtaaggtgaccgggatttgcggcgtccctgtctggcccggcatcagtagcggacggaataaggtggttccacggcaatcgctgttatacctcaggttgaacggttctttcgcacgaacaacgcgcccatccgctcgccagccggccgcggctgagcaggtgacgggttttccgataatggcttcaagcgccgttatgccgcgcgcaatatcttcttcaagctggcggatactccagtggccgctgtgagtctgccacgcatggtgatcccaggcatgtagtcccgtctcatggtatgttgccgtttcacgaataatcccggcattagcgttgccgatattttttcccggccaggcggtgccggccagcaggatatcccaaccgtagagcgaggcggcgtttgaacgtagcattttccataaaaatcgcggttttatcagacgccaaagatggcgtcccatattgtccggcccgacgctgaagaaaaagctggcctgaacgccgtggcgatgcaatgtcgccagcagccggggaacaccttcacgcgttcctcgcaaggtatcaacgtcaatgcgtaaaccgactttcgtcatgatgcgcgttccgcgatatcgacgctacgcagaaagaagtccagcgttttttcaaccgtatcacgcatcgcaatagacggctcccagtccagacagcgcctggcattgtcgatactgggtttccggtgtgcgacatcctgataacccttgccgtaataactacggctttcgacgacctggaaaccggcaaatggtgggaaatggcagcgcagcggatgcttatcaaaactgtcgagcaacagcgtcgccagttcctgaatactggcttcgttgtcagggttgccgatattaatgattttgccatcgcaccgatcgccctcattcacaataatgcggaataatgcttcgatcccgtcacgaatatcggtgaaacagcgcttctgctgaccgccgtcgataagcttgatcggcgtcccttctaccaggttcagaatcaactgcgttatcgcgcgtgaactgccgatacgcgccgcgttcaggctatccagccgcggccccatccagttaaagggacggaaaagcgtgaagcgcaatccctctttttcgccataagcccaaatcacccggtcgagaagctgtttggaaacggagtaaatccagcgcggcttattcatcggcccgacgatcagattcgatttgtcttcgtcaaaagaggcgtccgtacacatgccgtacacttcagaggtagacgggaaaaccacgcgtttacggtatttcacgcaataacggataatccgcaggttttcttcaaaatcaagttcaaagacgcgcagcgggttgcgggtgtattcaatcggggttgcaattgctaccagcggcagtacgacatcgcattttttgacatgatattcgatccattctgagtggatgctgatatctccctccacgaaatgaaagcgagggtggagcaggaatcggctaatggcgttgctgccgatatccataccgtagacctcgtaattctcttcatccagtaaccgttcggtcaaatgattgccgataaaaccgttgacgccgaggatgagaacgcgaatgcgacgtttaccgctggtcgctggtggacggttcaaacacgcgcccgccaccagaccaagcgtctgtgcaagctgcgagccctgtacagtaatgccgtctccggcctggccggtaataatctccagcgcgccatcggcgcaggcgacccgcagcggagagaccgaaattaccgagccgggaagcgcgccttgcgcatccggacaaattcgggaagaccagatagtgaatttttgcgagccgttatagctgaacgcgccgggccagggggcggctaccgcccgcaccaggttatgcaccgtggaaaccggtttgtgccagtcgataaggccatcttccggcctgcggcgaccataatacgtagcgtcagactcacgctgaggaacagaaggtatattgccgcatttcatggtgggcaggatgctattaagtaactggcgcgcggcctgacatagcttatgatgcagggtaagcgcaacatcgtcctgcgcaatagcgacgcgttgactggcgacaatctctccggcgtcggcacgtttgaccatacgatgcagcgttacgcccgtttcgctttcgccgttaaccagaacccagtttagcggcgcacggccacgataggctggcaatagagaaccgtgcagattgaacgcgccagccggggcgaggtgcagaatttcttcgcttaacaggttgcggtaatagaacgaaaaaataatatctggcgcaagttcagcgatgcggtcgacccagataggatggtttacgttatccggcgcataaaccggaatccctaatcctgccgccagccgggagacggagccaaaaaaggtgttttccgcaagattgtcggcatgagtgaaaattgcggcaatctcatatcctgcatccagtacggcctgcacgccctgacatcccatatcgtgataggcaaaaataacggctttcattggtgactttcctcagtaaacgacgtgctttccgggtagataacttgttgaacaaaatagcgggggcgggcgcggacatcgttataaatgcgaccgatgtattcgcccagcagtcccataccgatgaattgcgcgccgatgaaggtaaacagaacggcaaagagcataaatacgccttccgccgcccactgcggtcccagtgccaggcgaagtacaataagcaataccgacaggctaaacccgccgatggcgataacactgcccagcagactcaacaggcgcagaggcgtcgtcgtcaggcaggtcaccaggtcatacatcaggttaatgagacgcataaaactgtatttagagtcgccaaattcacgttcagcgtgatgcaccgggatttcggtagcccgacgagcgaaaatgttggccagaatagggataaaggtgctgcgttcatggcagcgcaacatggtatcgataatagggcggcgataggcgcgtaacatgcagccgtaatcgcccatcgctttgcccgttgtgcgctggatcagcagattaatgatttttgacgccgatttgcgaaacaggctgtcctgtcggttctgtcgcacggtgcctaccacatcgaatccttcatcggctttcgccaccaggcgcgggatctcttccggcgggttttgcagatcggcatccagcgtaatgatgagatcgccgcttacatggctaaaccccgccataatcgctgcatgttgaccgtagttacggttgagtaaaatagagatgatatggctatcggcctcctgggacgccttaaccatcagctccgccgagctatcgctgctaccatcatctatcaataaaatctcccacgctttgcccagactctcgcaggcggtggtggtgcgtcttatcaattccggcaggctttcctgttcgttatagacaggaataaccaccgagactttttttatgggggcggcgtcaaacatgcttattgtcctgctatctgatgaagggcggtaatgacccgatcaaagtcactctcggtcatgtccgggaagagcggcagtgagcagatccgctcgctgttccactcggtgtcaggcagcgtgagcgttgggaaacgttcgcgataatatttttgcgtatgcgcggcgcggaaatgcagccctgtgccgatgcctttcgttttcagcgatgccatcagagcatcccgggtaataccgcagcgggcttcatcgacccggataatgaataaatgccaggcgtgaatatgctcccacggcggaaggctcagaggctgaaaaggaaggtctgccattgcctgatggtactgcgctgcgatggcggcgcggcgagcgttaagcgcatccagtttctgtaactgggcaagcgcgatagcggcgttgaagtcgggcaaattatatttgtagcccggcgccaggacttccgcttgtggcgcgcgtcctccgctctgtcgatcccaggcatcaacgccaagcccgtgaaacttgagactgcgcagtttatcggcgaattgcgggttatccgtgacgacgataccgccttcagcgcaggtaatgttcttaatggcgtggaaggagaaaatcgcggtgccccgggcgccaatgtggcgacctttgtagctggttcctgtcgcgtgcgccgcgtcttcaatcaccggaatgccataacgcgcgccaagagcgtaaatagcgtccagatcggcgggcgcgccagcgtagtggacggggataattgctttggtttgtggcgtaatcgcggcttcgatatgttcaggcgtgaccatcagcgtatcgcgatcgacatcgaccatgacgggggtcgcgccgagtaaaacgatcatatttagcgtagaaacccacgtcattgacggtgtaatgacctcgtcgccttcaccaatacccagcgccatcaacgcgatgtgcataccggcagtggctgaactgacggcaacggcatattgattgcctgttagccgacaaaacgccgcttccagttcctgatttttcgggccggttgttatccaacctgagtccagtacggtcttaacggcagcgagctcttccgcgcccatcgccggacgggagaaaggcaaaaagtccgacatcatttttccttcagccattgaaagccgcttttcaaatatttcggcaatagaaaagggcttattttttaacgcatttagctgaaccctactggatgaagattaaattaacattaagaaattaaggtgaagtaaaaagataattttaacggaattatgctttgctttcgccgaaagtttaaggcattttatgcatgcccaaaagctgtttttatgtttctggtcttccgtcgcggaatttcattttaatcgtattgctattaagttagctgcactgtctgcctgagaggttaatgtgctggcatttaccctacgctttattaaaaacaaacgctatttcgcgattctggcgggggcgttggttattatcgctgggttggcctcacaacatgcctggagcggtaacggtctaccgcagattaacggtaaggcgctggcggcgctggcgaagcagcatccggtagtcgtgttattccgccatgccgagcggtgcgatcgttccgataatacctgcctgtcagacagcacggggattacggtcaacggtgcgcaagatgccagagcgctgggtaaagccttcagtgccgatatacaaaattacaatctctattccagtaatacggtgcgcaccatccagtcggcaacctggttttccgcaggcaggtcgcttacggcggataaaaaaatgatggattgcggcagcggtatttatgcttcaatcaatacgttactgaaaaagtcgcagaataaaaatatagtcatttttacccataatcattgtttgacgtatattgcaaaaaataagcgcggcgtgaagtttgatccggactatcttaatgcgctcgttatgtatgcggaaaacggaaaactctttttagacggtgaatttgttcccggctagccgcatgttaaaagcgtaaagacagcctgaagcggctgtcgttattataataaccctttcaatgctaatgtgtggcgtgtcgctacattcaaatcatacagcgccagttcttctggcttgacccaggcgtagtcctgaaattcgtcgttaatacatatatcgcggttagcggaaacacagtcgaagatgagataaatcatataaatctcttcttgtctgccatcagcgtacgttttaacgcggatatcgtcgcgaaaggtccacggcgtaatatcgctcagaatcagttgttcgccgagttcctcccgaatctcccgacgcagcgcctcttcaatacgttcgcctggctcgaccccgccgcccgacagcgcccactgaccgggaaagacgccgcggttgtcggccattttgcacagcagataacagccatcattttgaattaatgggcaaactatagttcgttgacgcataagtcgcttccttaaaccaccaggccatcagcttaacaaatcattctgcgaaattctttgtgaaaaatggaagcgataacgcagactgcgttttttgttaattttgttgatgcaggcgtcgccatgtgatggcgcaatgatgcgtcacggcgaaagtagtatttcgttacaatatgtttttggaatggtttcttagtgcattgattcctcagcgtctggcagtacaattctgccgttttggggagtttttctttatgtgcttgctggaaagggtaaaaatgaaaaaaagcatattattaggttttgccggaatgctgttcgtttctgcatcggcgcaggccatcagtattagcggccaggcgggcgaagattacaccaacattggcgtgggttttggtacggaatcgacgggactggcgctaagcggcaactggatgcacaacgatgatgatggcgacgctgcgggcgtgggtctggggctgaacattccggtgggaccgctgctggcgacggtaggcggtaaaggtatttataccaatccgaaagacagcgatgaaggctatgcggcggctgtcggcggtgggttacaatggaaaatcggcaacagcttccgtctgttcggcgagtattattattcaccagattcgctgtccagcggtatcgaaagttatgaagaagcgaatgcaggcgcgcgtttcaccattatgcgcccgctgagcattgaagccggttatcgttacctgaacctggcgggtaaagacggcaaccgcgacaatgcgattgctgacggcccttatgttggcgtaaacgccagtttttgatgctaacggcgcggcaatcgtcgcgccatattcctccttttcccgtcattcttctttccacgtcatattcgtctttgcgttatagtgttttcatcataaaagcaggagaacacaatgctaaatgtggaaatgctatccaccggggatgaggtgttgcacggacaaatcgttgacaccaatgccgcctggctggctgattttttctttcatcagggcgttccgttatcacggcgaaatacggtaggcgataatctggacagtctggtcgctatcttgcgtgaacgcagtcaacatgctgatgttttgattgttaatggcgggttagggccgaccagcgatgatttaagcgcgctcgccgcggcaacggcaaaaggcgaaggattagtactgcaccaggcgtggctgaccgaaatggaacgttactttcagcagcgtggtcgcgtgatggcgccgagcaaccgtaaacaggcggaactgcctgccagcgcggagtttattaataatccggtcggcactgcctgtggatttgcgctacagctcaaccgctgcctgatgtttttcacccccggcgtaccgtcggaatttaaggttatggtggagaaggaaatcttaccgcggttacgcgcgcgtttttcgctgccggagccgccgctttgcctgcggttaacgacttttggacgttcagaaagtgacctcgcgcagcgtctcgattcactgccgttgccgcccggcgtgacgatggggtatcgctcatcaatgccgatcattgaactgaaattgaccggcccggcgacgcaacgggaggcgatgctggcgttatggccagaggtcaaacgggtcgccggacagaacctgatttttgaaggtacggaaaatctgccggcgcaaatagcccgccgcctgcaggaaaggcagttgagtctgacgttgagcgagcaatacaccagcggtttactggcgctacagctttcccgtgccggggcgccggttcttgccagcgaagtcgttccttctcaggaagagacgctggcgcaaacggcacactggacgacagaacggcgcagcaatcattatgccggtctggcgctggccgtgtcggggctggaaaacgaacatcttaatttcgcgctggcgacgccggatggcacgtatgccttacgcgtgcgttttagcgccaatcggtatagtctggcaatacgtcaggaggtctgcgcgatgatggcgctaaatatgctgcgccgttggcttaatggcgaggacattaccagcgagcatggctggatagacgtggttgaatcattgacattataatccctttctcttatctgcgatgggaacgacatcgtgagccggataaggccgctatgccattatccggcaatattatctgcttttttgtccagccaattgtactgaatacaaagtaatacgtgcgttaattcacatttatatggttaacccttccactccgttggaaggcggataagctttgacgcgcttcacaattttttccctactgacctttcacactgattccagtgtctcagactggagtccaatatgttggaatcaagtaaagtcccggctcttactcgcgcaatcgacatcctcaatttgatcgcgcgtattggcccatgcagcgcggcaatcattattgaaacgttgcgtattccaaaaagcaccgcgtacctgctgttgaatgaattaaaacgtcagcgatttattagcctcgatcatcaggagaactactgcctgtggactaagctcgttgaattgtcgggtcatgcgctcagcaagatggatctgagggagctggcgcgtcctcgtctaacacaactgatggatgaaatcgggctgctgtgtcacttggggatcatcgaccacgaaaatgcgtattacatactgaaagtggaatcctcatccactatcagcgtgcgctcgcatgaggggaaaagcctctctctttatcgttccggcatcggcaaatgcctgctggcatggcagccggccgccgtacgcaaagccattattgaaaaaatggtatgggagcgagccacgctgaccaccatcaccgagccgcaacaattgaatgatgagctggaacgcattcgccagcgtggatggagctttgataacggggaggattatccggatgtccgctgcgttgccgcaccggtatttaatgccagaaacgaactgaccgcggcaatttcactggtcggcacgcgcctgcaaatcaacgaagagaatcttgattatttggccggtaaagctattgcctgtgccaaagatatttcacgcctgttgggatggaaaagtcccttcgactcactcgcatcttaaaatggagaatattatgactcttcctaaaattaaacacgttcgagcctggtttattgggggcgctaccgcagagaaaggggctggcggcggggattatcacgaccagggaggaaatcactggattgatgaccatatcgccactcccatgagcaaatatcgcgactatgagcagtctcgtcagtcttttgggatcaacgtgttagggacgctgattgtcgaagtagaggcggaaaatgggcagacggggttcgccgtttcgacagcaggggagatgggctgttttatcgtagaaaaacatcttaaccggtttattgaaggcaaatgcgtaagcgatatcaaacttattcacgatcagatgctcggcgcgaccatgtactactccggttccggcggtctggtgatgaacacgatttcctgtgtggatctggcgctgtgggatctgtttggcaaggtggttgggctgccggtttataaattgctgggcggagcggtacgcgatgaaattcagttttacgccaccggcgcacgcccggatctggctaaagaaatgggctttatcggcggtaaaatgccgactcactggggaccgcacgatggtgatgcggggatccgtaaagatgccgcgatggtggcggatatgcgtgaaaagtgcgggccggatttctggctgatgctcgactgctggatgagtcaggatgtgaactatgcgactaaactggctcacgcctgtgcgccatttaatctcaaatggattgaagagtgtctgccgccgcagcagtatgaaggctatcgcgaattaaaacgcaacgcgcctgcagggatgatggttaccagcggcgaacaccatggtacgctgcaatccttccgcactctggcagaaaccggcattgatattatgcagccggatgttggctggtgcggcggattaaccacgctggttgagatcgccgcgcttgccaaatcgcgcgggcaactggtggtgccgcacggttcgtctgtctattcgcaccatgcagttattactttcactaatacccctttcagcgagttcctgatgaccagcccggactgctccaccctgcgtccgcaatttgacccgattctcctggatgagccggtgccggtgaatggacgcatccataaatcagtgctggataagccgggcttcggcgtcgagcttaaccgtgactgtcacttgaaacgcccttatagccactaataactcgtgcgttgcctttgtacggcaacgccctcatcctgttgaggatattgctatgagcatcactttacttgacggcgtagtgaagaaaaaccgcgcacgtttaattccttttatgttggcgctgtacgtactggcgtttctggatcgttcaaatattggttttgccaaagagacctatcagatagataccgggctaagtaatgaagcctacgcgctaggggccggtattttctttgtggtttacgctttccttggcgtaccggctaacctgctgatgcgcaaatttggcgcaagaacctggatcggcacgactaccctgctgtggggctttctctctgctgcgatggcctgggcggatagtgaagcaaaatttctgataatccgcacgctattgggcgcggcggaggctggatttttccccggcatgatctatctaacttcacaatggttcccgcagcgtaaccgtgccagcattatggggctattttatatgggcgcgccgctggcgttaacgttgggttcgccgctctccggcgctctgctggagatgcatggttttatggggcacccgggatggttctggatgttcgttatcgaaggcctactggcgattggcgcagggatattcacctttttctggcttgatgacactccgcagcaggcgcgttttcttagcctggaagaaaagaacgcgcttatcaggcaactggcgagcgaagaagagaaaaaggtcacgtcaaggcttgcggatgcgctgcgtaatggacgcgtctggcaactggctattatttatctgacgattcaggtggcggtatacggactcatctttttcctgccgacccaggttgccgcgctattgggcactaaagtgggctttaccgcttcggtggtaacagcggttccctgggtggcggctttgcttggcacatggcttattcctcgctactccgaccgtaccggcgatcgccgtaacgttgcggcagtgacgctactggctgcgggcattggcattggcctgtcaggtctggtttctccggtgctcgctattctggcgctctgtgttgcagcagtaggatttattgccgttcagcccgtattctggaccatgccaacgcagctactttccggtacggctctggcggcaggaattggtttcgttaatctgtttggcgctgtgggcggttttattgccccaattctgcgcgtaaaagcggaaacgttgtttgccagcgatgcggcgggcctgctgacgctggccggagtcgccatcattggctcattaattatcttcacgctgagcgttaatcgtccggtggcgcaatccggcgctgcgcatcattaatcttatctacgttgtaaggatcgctatgaacgcattgttatcaaatccttttaaagaaggattacgtaaaagggatacgcaaattggtttgtggctcagttcaaccacctcttatatggcggagattgcggcgacgtcgggttatgactggttgttaatagatggcgagcacgcgcctaatacggtgcaggacttgtatcatcagttacaggccatcgccccatacgccagccagccggtgattcgcccgatcgagggaagtaaagcgctcattaaacaggtactggacatcggggcgcaaacgctactgatcccgatggttgacaccgcagaacaggcgcgccaggtcgtttccgctacccgatacccgccgttggggcaacgaggcgttggcgcgagcgtggcgcgtgcggcgcgctgggggagaatcgacaactatatggcacaggccaatgagtcgctctgcctgttggtgcaggttgaaagcaaagtggcgctggaaaaccttgacgcgattctggaggttgaaggcattgatggcgtctttatcggtccggcagatctctctgcttcattgggttaccccgataatgccggacacccggaagtgcagcgaatcattgaatcgtgtatttatcgtattcgcgccgccggaaaagcggcgggttttttggcggtcgatccggcaatggcgcagaaatgtctggcgtggggcgcgaattttgtcgcggtcggggtagatacgatgctctacaccgaggcgctggacagcaggttggcgatgtttaaatctgttcagtcagtaagcacggcaaaacgtagttattgagaaaaatgccggatggcacgtatgccttacgcgtacgttttagcgccaatcggtatagcctggcaatacgtcaggaggtctgcgcgatgatggcgctaaatatgctgcgccgctggcttaatggcgaggacattaccagcgagcatggctggatagacgtggttgaatcattgacggcatagaacttttagtgggaaggcttggccttcccatccttatatacttataaattcttggcagagcatcatttcaggataagtactcgccattactggagactgtattcatatatttgtcgccgggtttgggtgttaaatagtgtttgttcctctactgaaagcgttaagaaattttccgcaaattctcgtagtgtggtagcaggatcgttttgtcctgcattcgataagagttgaattgtatggtaacaaaatagaccacagccgttgggtacattattttgtaaattggtttcaataaaatcaatatcttcgttttctgatatgcctgcaatttttgctgcttctataatctcttgcttagtattttcatttaaatcatgataagtattaaatataaggcattttattttttctgcaagtttataaaataaacagataagccagtgatctcctgtatttatcagaaagacttcattttcagataatcctgattgagccatcttttcaagtagctgagtgcgtaatatattttctttggtggtaggatgaataagcccaataggatagtttaccgagagaagaggtgattcttgaaccagacctagcgttgcggctgctagctcatctgacgacaacattcgcgcactacaccaaagattttcaactcctacctgttcttgatctgtttgagcgaactggtcgcccataattttatgtgctattcctatttttttagaaaggtcggttgtcgcggaaccggccatataaagtaatctggaaggggcatgtagctttttccactcagtattatcttttgttatatcgttattggcgatttgatgtaatacaaggcaagcctgattgatttttttgtctatgtctggtgatcccgatctttttccgctaaagagatcaaaaagaaatttctcaactctatgtcccaggttatcattgcgtaacgcaagattgcataacagatcaatacaattctgatcaccgttctctacggcgctaaacaacaacgcaagcgcctcatcgctcacctcttctgaatataaactgtgaaattgcggtgtgctcaatcggtaaagtgaatttacacatatattcattttgctctgtttcctggtaggtgaaagtaacgaatatgatgtcatgtataattatttgtaaaaatattattgttagtgggagatatattaaatcaggcatagacctgattttattattattcacataacactcaattattattggagatattcagttatccccctctttaaaggaggctggtaacgcggcgatacaagagatattgctctataaacagtaacgtcgttatctgtcatgccaccgtgggttagcggtcatggttaaccaaatagggcaggttattgcaaagagacatccgcgtttatacccaaaataatccgtagccaacacataagcaacttgaagtatgaagggtatatgtctgatggaaaatcggccctggtgagtagagtaatggcgccggaggggctccggcgctttttacttagcccagcgctttcgccagtagcgtaatggggtattcgcagcgtttgcttgtagacatctcaatttgccacttacaggtttcacaatcggtgacgacaatgtcggcgccgctctcttcaatctggcggaacagcggcgcgccgatggactgtgatgtcggatagttttcctttttaaatccatacgtaccggcaatgccgcagcactgtgaatcaagtaccgtcaattcaagccccggaatttgtcgcaacagttcaagcgtgtaaagcgtccagcccattttttccatatgacacggcgtatggtagaccactttcagcggcaaaggattaagcggcagcgttttcccggcatccagtttgcgccatagccagcgggtggccagctcgatatgttcgcgcagcccggcgttgtccacgtccagcacttcaggatattcatcgcgcaacgcaaacgtacaggtggatgacgtggcgatgaccggaatacctttgacggcaatcgcctctcgtagcgactccacattgctgatagcctgtttgcgagctttatccgtaaaaccgttagcgatcagcggtacgccgcaacacttctctttactcagtaactgtacgccagtacccattgcgttcagcaccttaatcagatcttttccgagctgcggatggttgtaattcacaaaacagccatggaaaaaggcgacctgatctttgtatttagcctgctgcgccgccacgctacgataccagcggcggaaggtgccgaaagagtattttggtaaggtgcggcgatgatcgattttgagcgcgtaatcaagcaactggcgcactggctttaatgcggtggcggtattgaccaccggcgcgaacggcgttgaaacgctgcccatcagatcggtatggctgagaataaagttacgcaatgacgggcgcgtcgtatcgtatttcgcgcgggcgcgctggatgatatcgccaatcttcacgtccgacggacaggcgacctcacaccgtttgcagttaatgcaatatttcagcgcctcatcatacagcgcgccgtctttcagacgcaggcgttcgccatccggtccggcctgtttagggccagggtagccaggattaacgcggctgaccgggcacgcggtggtgcacaccgtacatttaatacaactttcaaaacgtgtgtcgctcattgctgttctcctgcacgctcagcgatatggtgcgcggcctggagggcgctgactgcgcagacgccgccgccgcatccctcagctataggatcgaatcccgccagcacagaacctattgcatacagattttctaccgtgttgcccgcaagggaggggcggaaagcgtcatccgtcacgacgccaaactgctgccagggctgtgggtcgaagaaatgttgttgataccattcggcgcgggtggccgtttgctgtacgtcgagccctaaaataggttcgcggatcccttcgcgctcggcaaccagcccgctactaaagaagctaccgctggcaagtacggcaaaacgcgggcgcagtgggatatcggcatggttgcgggtccatatttcgctcacggtaccgcgacggcaggtgactttcttcacttcatcgcccggcatccagatgccgccctgacggacaaactggcgctggagttgattgtgcagacgaataccgagcaccgatggcggcagcgtcggcagcagcgtgagcgcgcagggcagacgttcgttaagccagcgccacagcgtatcgttcgccagcccgaaacaggcgggcatgatgatcatgtcgcagtttgtcgctattggcgacagcgcgtcgtatagcagctgccatttttcttcgttatcaagcagacgcgcgatattgaccgcgcgaaattccgtcgggttatcacgcagtacgtccagttccggaaggtcgatttctgcggtttcaacgttgaggtcgcgttggcgcagcgacgctgccgcaaggtgcgcctggaaatccagtaatccgctaacgccgacgacgcaaattcgctgtgcggataacggccagaccggtacttccggcgagctaagccaggtagaacgcaatgtgccaagcggcgtgacacgctggtgcgcctgctgtacgtcgccgtataactgcgcgccgctggcgttaagtagcgtttgcgcctgttgcgccagcgtaaggactttttgcgcgcctaaacgcgaataaggatgttcaggcgcctggcggcgcagcgcatcaagcccggcggtaatgtcggtcaccggttggccgttgggcagggcgctaagtagatccagcgagccggaggaaaaatgcagcgcgctttgtccgcgggtgacgatggcgcagcgtaatccatgctgctggagttgcagtccgcatagcaaaccggcgagaccgccgcccataataaccgtatcaaatttcatcctggtgctccttctccagaccgcataatccctgataaacccagcgcgtgaattcgctttcgcgcagcgcgtctccccaggcgacaggttgtacgcctttccagcgctcattcagaaattcagagagttgcgtaatagattgcgccgcggtcgtcacattaaaacgctgcaatagcccggccgcgcggcaggcgcacagttcgccctggcaagtgcccatccctacgcgggtgcgacggcgcagatccagcaggctattcacggttaagttttcgacggcatactgcacttcccccgccgtgacggcctcgcattcacagaccaggctacggtgttggcggccttcactcagccaccccggcgtgcgatcgccatgccgataaaccgccgatccgcgtagcggcgcgggaagcgagataatgcgtttcagcgtatgttccgtagactcttttgagccaggcaacggcgtatccgccgtgatgcaggggcgagtattgcccaacttgcggcacacggcgtcggtcgcccattccgccatcaggcgataagtcattagcttcccgccggtaatggtaatgaagccatcaagcccgtcgcgttcggcgtggtcgaacaacacaataccgcggctgacgttacgaccgctgggatcgtcatcgctggccaccagcgggcggacgccggaatacgcgcgcagaatacgtgtcttcgccatgacaggggccagtttttccccttcacgcagcaggatatcgacttcatctgcggtgacgcggttgctgtctatctcattgtaatcaatatgggtagaggtggtgccgatcagtgaaatcgtatcgccaggtaccagaatgtcggcatccgatggtttccggcagcggttaatgacatgctggttgatccgatggtccatgatcaacagcgagcctttcgccgggaacatgcgaatactcaggtcggcgtattcggcgatccgttgcccccagataccagccgcattgaccaccaccggcgcgtgaagcgtctgggtttcgccagtgagatggttacgcacatggacgccgcagaccgttgcgccttcacgaatgagcccggtcacttcatgcgccgttaacacgattgcgccatgttctctggcatccagcatattggcggcggtcaggcggaaagggtctacggtgccatccggcacttttaccgcaccgatgagcgcagggttaacggaaggttcgatgatgcgagcctgctgcggatcgatggcttcagcgcgaatgcctgccgcttcacaggcgcgaataaaggtggcctgaaacgcaagaccatcttccggcaacgtaataaacagaccatccgtcggttcgacgcaatggcgggcgatccgttttaaaatctggttttcactaatgcactcgcgcgcggattccgcgtcggtaaccgcataacgagcgccgctgtgcagcagcccgtggttacgcccggtcgcgccggtcgctatatcatgccgctccaccagaatgacacgtaaaccgcgcagcgcgcagtcgcgggcgatccctgcgcctgttgctccaccgccaatgataatcacgtcacttgcttgcgagtcgcgagttttcattgtttttccttacagttcgttttttatcatttagccatacaaatcatatggaatgtttgatttcgcgcgcctttctgaacattagtcataaaactgtaacaatatgtgctgtaattcacattaacgtgacgtatctttacttaacatcgcggccacactgggagcagcggggttgtttgaacgaactgcggtgtttacctctaaataaaatacgggctacggaggctacaatatgttgagtatttttaaaccagcgcttcataaagcgcgcttgccagcggcggagattgatccgacctatcgccgattacgctggcagattttcctggggatattctttggctatgccgcgtattatctggtgcgcaagaactttgccctcgcgatgccctacctggtagaacagggtttttcacgcggcgatctgggctttgcgctgtccgggatttctatcgcttatggtttttcgaaatttataatgggttcggtgtccgatcgctcgaatccgcgcgtttttctgccggcagggttgattctggccgcagcagtcatgttgtttatgggctttgtgccgtgggcgacatccagcatcgccgtgatgtttgtgctgttgttcctttgcggctggttccaggggatggggtggccgtcgtgcggacgtacgatggttcactggtggtcgcagaaagagcgcggcggcattgtgtcggtctggaactgtgcgcataacgtcggcggcgggatcccgccactgctgttcctgctggggatggcgtggtttaacgactggaaagcggcgctctatatgccagcctttggcgcgattgtggtggcactgttcgctttcgcaatgatgcgcgatacgccgcaatcctgcggtctgccgcctatcgaagagtataaaaacgactatccggatgactacaacgaaaaagcggaagaagagctgactgcgaagcagatcttcatgcagtacgtactgccgaacaaattactgtggtatatcgctatcgccaacgtgttcgtctacctgctgcgctacggtatcctcgactggtcaccgacctacctgaaagaagtgaagcatttcgcactcgataaatcctcctgggcctacttcctctatgaatacgcgggtattccaggcacgctgctgtgtggctggatgtcggataaagtcttccgcggcaaccgtggcgcgtcgggcgtattctttatgaccctggtcactatcgcgaccatcgtttactggatgaacccggcaggcaacccgaacgttgatatggcttgtatgattatcatcggcttcctgatctacggcccggtaatgttgatcggtctgcacgcgctggagctggcgccgaaaaaagcggcgggtacggcggcgggctttaccggtctgtttggttacctgggcggttctgtcgctgcaagcgccattgtgggttataccgttgacttcttcggttgggatggcggctttatggtgatgattggcggtagcattctggcggtaatcctgctggtggtcgtgatgattggcgaaaaacgccatcatgatgagctgcagttaaaacgcaacggaggctaataacatgaaaaccacactgaaaaaccttagcgtggcgttgatgttggcaggaatgaccatcggaagcggcgccgtggcggctgaaaaagtcgtcatcgcccaccgtggcgccagcggttatctgccggagcatacgctaccggcgaaagcgatggcgtatgcgcaaggggcagattatctggaacaggatttagtgatgacaaaggacgaccatctggtcgtcctccatgaccactaccttgaccgggtgactgacgtcgctgatcgttttccggaccgggcgcgtaaagatgggcgctattacgctatcgattttacgctggatgaaattaaatccctgaagtttaccgaagggtttgatattgaaaacggcaaaaaagtacaaacttatccgggccgtttcccgatgggaaaatctgatttccgcattcatacctttgaagaggaaattgaattcgttcagggattaaatcactctaccggtaaaaatatcggtatttatccggaaattaaagcaccgtggttccatcatcaggaagggaaagatattgccgcgaaaacgctggaagtgctgaagaagtatggttacatcggcaagcaggacaatgtctatttgcagtgttttgatgtcgctgagctgaaacgtattaagaatgaactggaacccaaaatggggatggatctcaatctggttcaacttattgcgtataccgactggaatgaaacccagcagaaacagccggacggtcgttgggtaaattacaactacgactggatgtttaagccgggcgctatgaagcaggtggcggaatatgcggacggtattggtccggattaccacatgttggtcgcggaaggttcgacgaaagggaatatcaagctgactggaatggtgcaggacgcgcatcagaataagatggtagtgcatccttacactgtgcgtgccgatcaattgccggactatgccacagacgtcaatcagttatacgatatcctgtataacaaggcgggcgtcgacgggctgttcaccgacttcccggataaggcggtcatgtttctgcaaaaaaatgactaaaggtatgccatagtagaagtgaagcgccggatgaggacataaacgcctcatccggcctggcgcaacgtttgccagcgtaagtctgataaacgcaatgtcatcaggcggtgttgttttatagcaaaccctcatcggtcagtgtttccatacatttttgtaataaaaatagcgggcttccttctaccggcggttcttttgctaacagtgaaatttgtcgataaaaggtgggttccagcgccacggagcataattttcctgtcgtggcttttaaggttaattctggcaataaggcgatacctaatccctggcgaataaaattcagcgcagtatcgggatggttaaattcatatttaaatatcggttcaatacccttttctttaaacaacgccataatacttaattcataacgacctttactgacaataagtggttcgtccatcagttcttcgaccgttactgtactattggccgccaggggatgattttcaggcaccactacggtgaatttatcccggtaaatggggacgcaatacataccgttgaccggaaaaggaacgaaaccggcatcaatacttccgtcctgcagcgaatcaataatagccgtactgttctcttcataggggataatttttacatttggatgatggctttcaaaatagcgaatgacgccgggtaaaatgcaggcgcaggcgctgggaaaacagccaatccgtagcgtacgggccgggttctttttttcttgttcgacaatctcttttaccgcgttgacgtcgcgctggatcgcgcgtaagtgcctgacgatgcggctaccggcggcggtaagctcgatctctttacgacgctcacgaatcaatatgtcaacgccgagctcctcctcaagcgcggagatggcctggctgacggcggattgcgtcatgtatagccgtttgctggcctcggtaaatccgccgtactccagtacggcaagcagggcatggatttgggttagcgtcattagtaaaacctaatcaatataattaaaacgattaatttttctaataaagtgcacttgtttatactgcgattctatcgaatacatcacattttgacgcacctgataggtgttcagttgagctgagcgttgcctgcgtgcgccatctgaatgggtcgttaagaatgaaagaaaaattatggacgaaggatttttgggcaatcaccatagtaagttttattatcttttttgttttttatgtactgctaactttattacccatttatatcgctgaccgcctgcatgcttctgcagataaggcaggattgctagtgacatgtttcctggccgcggcaattgttattcggccgtttgccgggcagtgggtgggaaaatattcgaataaaaagattctggtgctctcttctttggcttttttggtgattaccgcgctgtatccagtttgccattctatcgagtcgctgctctttatccgcgtacttcatgggattacgtttggtgttattaccacggtaaaaggaactatttcagcgcggttaattccggcctcccgacgtggagagggcatcagctttttctctttagcgatgggcctggcgatggtcgtaggaccgtggattggtttgaatatggcccgctgggacgcgttcactgccgcattctggctttgttccgctgtagcggcgttagagattgtgctttccctgattgtgacggttcctccggtaattcgtcatgccgatggttcgaaaccgaatctgggtttttccgcgatgtttgaccgcgccgccttgccttttgcgctggtcaccttttttatgactttctcctatgccggcgtgtcggctttcctggcgctgtatgctcgtgagctggatttaatggcggcggccagtaatttcctgctgtgctacgcgattttactgatgatatgccgtaccttcaccgggaatatttgtgataaaaaagggccgaaatatgttgtttatccatgtctgttggcttttaccatcggtctggtggcgctgggctacaccaatggcagcatcatgatgattatttccggcggtctcatcggtatcggctacggttcggtcacgccggttttccagacgcaaattatcagctcggttgaaccgcataaaatcggtgtggcgaattcactgttctttaacgcgatggacgccggaatggcgattggcgcctttatcatgggaatgatggttgagtcggttggctatcgtatgatttatgtcgctggcgcggtgctggtggtactcgctggcgcactgtatgccgtgcagatgaaaaaacgtggcgtgatgccgttggtttccaccagcgagttgcactgagttacatctcgatttcgatatcgccttttgccctgcagcagcagggcaaaatctctcccggctggataaacgctaaaggttccgtaatccagtcaacctgaccggcaaccagccgggtacgacaggagccgcaatatccttcgcggcactgatactccacctcaacgttatgcgattccagcgcggccagcagagaagggtgttcatcctggcacagcagctgtgtgccagtgatacgcagcgtgacgcgtcccatcagagctggaaattactcagatcgtcggtatcgacttccgaatcgatttgtccgaccagataagaactaacttccacttcctgtggcgcaacctgaacgttatcggacaccagccaggtattgatccacgggattgggttggagcgggtctggaacggcagatccagacccactgcctgcatacgaatattcgtaatatattcaacgtattgacacaggatatctttattcaggccgatcatcgaaccgtcgcggaacagatagtccgcccactctttttcctgctgcgccgcctgcacgaacaggtcatagcattcctgtttacactcttcggcgatttccgccatctccgggtcgtccacgccgctacgcaacaggttcagcatatgttgcgtgccggtcagatgcagcgcttcgtcacgggcgatcagacggataattttggcgttgccttccatcagttcacgctcggcaaatgcgaaagagcaggcgaagctgacgtagaagcggatggcttccagcgcgttcacgctcatcaggcatagatacagttttttcttcagctcacgcagattcacgacaaccgttttgccattaacggtatgggtgccttcaccgagcagatgccagtaactggtcatctcaataagttcgtcgtagtaggcggagataccttcggcgcgcttctgaatttgctcattggtcacgatatcgtcaaacacgaccgccggatcgttgacgatgttacgaataatgtgggtgtaggatcgtgagtgaatcgtctcagaaaacgcccaggtctctacccacgtctccagctccgggatggaaatgagcggcagcagggcgacgttcgggctacgtccctgaatggaatccagcagcgtctggtatttgaggttgctgatgaagatatgtttttcgtgctccggcaacgcctgatagtcgatacgatcgcgggagacgtcgacctcttccggacgccagaagaaagagagctgtttttcgatcagtttttcgaagatgtcatatttctgctggtcatagcgtgcaacgttgaccggctggccaaagaacatgggttccttgagctgatcgtttttcgtttgtgaaaaagtggtgtatgccattgaagtgaatcctttatgggatgagcgccggatggcggcgcaaacgccttatccggcctacaaaccgtacaatcgtaggccgggtaagcatagcgctacccggcactattcatcagatcttacaagcgccgctttcgcagccatcgtcctgaatagaaggcgccaaatcgtcctgcgcatcttccgcgccgtcgcgggtattttgatagtacagagttttcacgccaaacttatacgcggtgagcaaatctttcagcagttgctgcatcggcacttttcctgacgggaaacgtgacggatcgtagttggtattagcggaaatcgactggtcgataaacttctgcatgatacccaccagttgcagataaccgtcgttgttcggcatctcccacaacagttcgtaagcgtctttcagatgctcataatccggcacgacctgacgcaaaataccgtctttcgaggccttgatgctgacgtagccgcgcggtggttcgataccgttggtggcgttggagatctgggatgacgtttccgacggcattagcgccgatagcgtggagttacgcagaccgtgggttttgatcgactcacgcagctgttcccagtcgtagtgcagcggttcgttgacgatcgcatccagatcttttttgtaggtgtcgatcggcaaaatgccttttgcataggtggtttcgttgaaccatgggcaggcgccttgctctttcgccagttcgttggacgctttaagcagatagtactgaatggcttcgaaggttttatgcgtcagattattggcgctgccgtcggaataacgtttaccgtttttcgccagccagtaggcgaagttaatcacgccaatgcccagcgtacgacggcccattgcgccgcgtttggcagccggaatcgggtaatcctgataatcgagcagagcatccaaagcgcgtactgccagaatagccagttcttccagctcgtccagagtcttaatggcacccaggttgaaggcagacagcgtacacaacgcaatttcgccgttttcatcgttgacatcgttcagcggtttggttggcagggcaatctccagacacaggttagactggcgtaccggggcgacaaccggatcgaacggactgtgagtattgcagtggtcaacgttctggatatagatacgaccggtagaggcgcgttcctgcatcatcagcgagaacagttcgaccgctttcacacgctgtttgcggatgctgtcgtcgttttcatacttcacgtacaggcgttcgaattcgtcctggtcggcgaagaatgcatcgtatagcccgggtacatcggacggactgaacagcgtaatgtcgccgcccttcagcaggcgggtgtacatcagtttgttgatctgtatgccgtagtccatgtgacgtacgcggttgccttccacgccacggttgtttttcagcaccagcaggctttccacttccagatgccacatcgggtagaacagtgtcgccgcgccgccgcgcacgccgccctgcgagcaggatttcaccgccgtctggaagtgcttgtagaacggaatacagccggtgtggaacgtctcgccgccacgaatcgggctacccagcgcacgaatgcggccagcgttgatgccgataccggcgcgctgggaaacgtatttcacaatcgcgctggaggtggcgttgatggaatccagactgtcgccacactcgatcagtacgcaggagctgaactgacgggtcggggtacgcacgccggacatgatgggcgtcggcagcgagattttgaacgtagagaccgcatcgtaaaaacgttttacatagtcaagacgcgtttcacgcggatagttagagaacaggcaggccactaccagaatgtagaggaactgcgcgctttcatagatttcgccggtcacgcggttttgcaccagatatttcccttccagctgcttaacggcagcgtaggagaaggtcatatcgcgatcgtgaacgataaacgaatccatctgcttgaactcttcttccgtgtagtcttccagcagatgattgtcgtatttgccaagctcaaccatttttaccacatggtggtaaagtgcgggcggctcaaactggccgaaggctttcttacgcaggtggaaaatcgccagacgcgcagccaggtattgataatccggcgcatcgcgagagatcaggtctgcggcggccttaatgatagtttcatggatatcggaggtcttaatcccatcataaaactgaatatgcgagcgtagctcgacctgagaaaccgatacgttattcagtccttctgccgcccaatcaagcacgcgatgaattttgtcgagattgatgcgctcagtacggccgtcacgctttgtcaccagcagactctgattcatgtagttttctacctgtttacctgtccgtgaaagaaaaatatcccccccgcttatccacaacgccacgttgtgactaactctgtggataaatactatatatagggggtaatcgataagtgaaacgctatatggtgagtattctagtagggattcttttgagtacaagagttgattttggcgttaaattgcggttgtaaaagagtaagaatcgctaaatgcgcgtctgataaggcctggagaggatgtcaacaattcataaaaaaatcaaaatttgatcgaatgctgattttttcatcgaagagaaaggttgcgcccgatgatctaacgcaacccttataggaaaattctttgatgtcaggcttttttagcgcgggtatgcaacatgtagttaacgtctactccgggaccgagtttgaaagtattggttatcgggttgtagtgcagcccggtgatatgttgctctttcaggacggtttcatctacccagcttaacagttcagcaggcttaatgaatttcttcacgtcgtgcgtgccttttggcaccatgcgcagaatatactcagcgccgacgaccgccatcagccaggatttcccattgcggttcaacgttgagaagaacacctcgccgccgggtttaaccagttgggcgcaggcgtggacgaccgattgcggatcgggaacgtgctccagcatttccatacaggtgacgacgtcgtattgctgggcgtgttttgccgcatgttcctcaaccgtctcctgcacgtactctacctcaatgccgctttccagcgcatgcagtttggcgacctgcaaaggctcaaagcccatatccagcccggtaacggtagcgccttcgcgcgccatgctctccgccagaataccgccgccacagccgacgtcgagcacctttttaccgaacaggccgcctgagcgctcagtaatgtagccaaggcgtagggggttgatgcgatgcaatggcttgaattcgcccttcagatcccaccagcgcgacgcgacggcttcgaatttggcgatttcattatggtcaacgttgtgagctaccgacggtttttcagtgttcatgagtacatgagattccgctattgatctatcggggcagtatagcaggtgcaaagtcgctgcgttatatctactgccgtctttattacgctttcagcgcaagaagttttcttgcgcgttctgtaaaaccgctaccgatgtggtgcgtgataaaattacagacgccctcgacgttgttgttttttaacatatctaaaatagtggcatgtccacggttagagctggtgatatattcagcggtaaaatccagtctgtagcgaattgccaataaacgtgcagagatcaacaggtgtgcttgtgaaatgtatttattatcggcatatttcacaaaaacataatgaaaatcatgatccagtttgaggtaagcttgcgtatctcgctctgcattaatttttgctgacttcgataaaatattgcttaattcgactatgacattgttagcatttttctccatcgcttcacgaattgcgccctgttcaaggataaccctcattttgatgagatcattgatatcctcgtcggtgacagaaaaaacaaatgtcccactgcggggaatgatgttgaccaggttttcattatagctcagccaaataaaagcttcacgaattggtgttttacttatcatcagaatatttgatagttcattttcactgatcgcttgcccaagatcgaaatcgccatggataatcatctcccttattttctctttaatcacctgggtgatggatttgggtatttcaattgatatgtgactaaaatcacgctttaatctatttttcattttcttctcctccatggttaaacccggctccattgtaattaatttattcaaaattaacggatctaatatatcagatataagaaaatttacatactttattgttgttattgtatatttcattaagtttgcttgctgatatatcagatatgacacattagcttttgaattgtattgttttttacgtaacatcgattccggtcaatacccttattcattgaatcataaaaggtgatgcaaaatgagtagtccacaagaaaatttatacgatgcaattcgtattgtaaaaaggaaaatcattcctttggcctttattctttacttttttaactatatggatcgtgtcaatattgggtttgctgcattacgcatgaatgaatctctcggtattacgcctgaggatttcgctaatatttcttctatattcttcatatcatatttaatctttcaaattccgagtagcattggcttgcaaaagcttggcgcaagaaaatgaattagttccattattatcggctggggagcggtaacagggctgattttttttgctaaagatactcaacatattttgctggctcgcatttttttgggggtatttgaagctggctttttcccgggcatggtttattatcttgcatgttggttcccggctcgtgaacgcggaaaagtcaatagtttcttcatgttatctattgctgttgcatcggtattggctgcaccgatgtctggttggatcatcgagcatttgaataccccggattatgaaggctggcgctggctttttgctattgaaggtatccctaccgtattccttggcatcctgacattttatttactgcctgacagtccagaaaaggctaaatggcttacgccacagcagatatcggccttagttaataaattacgcactgacaatgaaaccgcagctgcattaaataaaaataccaactcatcctttctttccgtaatcaaaaatccagttttgcttcagctttctttcgcctacatgttgattcaggcggctgctctggcggcaaactactggttgccggggttggtgaagggattttcagctgattttacggatactgacgttggtttaatcatgagtattccgtttattttcgctatgttcagcatgccctggtggggctggcattccgataaaaagaatgaacgaaaatggcatgctgcattacccatgtttctggcaggctgtggttttctgatgattgctcttgtcccctcaatgtcgctgagaatgctggggctaacgttctatggtgttgggatcctcagctattacggaccttactgggcgctgccttctgcattattgtcgccgtcagggttggctatcagcattgcgtttattaactcatgtttaagtcttggcggattcctgattaataagtcactgggattcgtttctactcattatggtgcgacaggaatatttattgtagaggcaatactttgcttcgctgcggtagccgttttggcgttaatgaaaattgatgtgaaaaaagaaaaaagccaacaaacaaatgttgtatcacgaacctgataaatggagaaattatgaaaattacgtctattgaagtttttgactgtgaattaaaaaaaagagatcaaacgatgtcatcctataatccagtacttatccgggtgaataccgactcaggattaagtggtattggcgaagtaggactggcctatggcgcaggcgctaaagctggcgtagggatcatcagagatctggcgtcattgattgtgggtgaagatccattaaatatcgaaaaaatttgggagttctttttcagaaagactttttggggaatgggaggcgggaacgttttttatgccggaatgagcgctattgatattgctctttgggatatcaaaggtaaatatttaggtgtacctgtttatcagctccttggcgggaaaactaatgaaaaattaagaacctatgctagtcagttacaatttggttggggggataaacgccagatattagtgacacctgaggaatatgctgaggcggcgcgtgcggctcttgacgatggatatgatgcgattaaagtggatccactcgaaatcgatcgtaatggcgatgactgtgtttttcagaatagaaatcgtaactattcaggattgttactggccgatcaattaaaaatgggggaagcgcgaattgccgctatgcgtgaagcaatgggggatgatgctgatattatcgtagaaatccattctcttctcggtacaaactcagctattcaatttgcgaaggcgatagaaaagtatcgtatctttctttatgaagaaccgagccatccattaaattctgataatatgcagaaagtttcccgttcaacaacgattccaatcgccactggcgagcgttcctacacaagatggggatacagggaattactggagaaacagtctattgccgtagcgcaacctgatttgtgtctctgcggcggaattaccgaaggaaagaaaatctgtgactatgctaatatttatgacaccactgtacaggtgcatgtttgcggcggtcctgtttccacggtagccgcgctgcatatggaaacggcaattcccaactttattattcatgaacatcataccaatgcgatgaaagcatctattcgggaactttgtacccacgattatcagccggaaaatggctattatgtcgcgccggaacagcccggattgggtcaggaattaaacgatgaggtagtgaaagaatacctggcctatgtgattaaatagcatctggtgatactgattatggtttatgcctcccggcatatcccctaaataattcgagttgcaggataaaatggttaaccgtcttgaacagcgcttgcgctaaccccgacggggcgaggcccagggatgggccgagtaacttgccgccaacgcacatgaaacttgaagtatgacgggtatacacgggaggtattgattttccagcctattcctggccaggcccagatctcctctgtgtcgcctctgaagctgatcgccgataaacgccgagaccacgcttataaatgaagagagcatgtggcacccgaataaagcattgtctggctgcattccgtttaccagtacgtgggcgaatgtgttataatttgcgacctttgaatccgggatacagtagagggatagcggttagatgagcgaccttgcgagagaaattacaccggtcaacattgaggaagagctgaagagctcctatctggattatgcgatgtctgtcattgttggccgtgcgctgccggatgtccgagatggcctgaagccggtacaccgtcgcgtactttacgccatgaacgtattgggcaatgactggaacaaagcctataaaaaatctgcccgtgtcgttggtgacgtaatcggtaaataccatccccacggcgattccgcagtgtatgacaccatcgttcgtatggcgcagccattctcgctgcgttacatgctggtggatggtcagggtaacttcggttctattgacggcgactccgcggcggcaatgcgttatacggagatccgtctggcgaaaatcgcccacggactgatggccgatctcgaaaaagagacggtggatttcgtggataactatgacggtacggaaaaaattccggacgtcatgccgaccaaaattccgaatctgctggtgaacggttcttccggtatcgcagtaggtatggcgacgaatatcccgccgcacaacctgacggaagtgattaacggctgcctggcgtatatcgacaacgaagacatcagcattgaagggctgatggaacatattccgggtccggacttcccgaccgccgcgatcatcaacggtcgtcgtggtatcgaagaagcctaccgtaccggtcgtggcaaagtgtacattcgcgcccgcgcggaagttgaagctgacgcgaaaacgggccgtgaaaccatcatcgtccatgaaattccctatcaggtgaacaaagcgcgcctgatcgagaaaatcgccgagctggtgaaagataaacgcgtggaaggcatcagcgcgctgcgtgacgaatccgacaaagacgggatgcgcatcgtgattgaagtgaaacgcgatgcggtgggcgaggtggtgcttaataatctctactcccagacccagctacaggtttccttcggtattaacatggtggcgctgcatcacggccagccgaagatcatgaacctgaaagatattatttcagcgttcgtgcgccaccgccgtgaagtggtgacgcgtcggactatttttgaactgcgtaaagcccgtgatcgtgcgcatatccttgaagctctggcgattgcgctggccaacatcgacccgattatcgaactgattcgccgcgcgccgacgccggcggaagcgaaagcggcgctgatttcgcgtccgtgggatctgggcaacgttgctgcgatgctggagcgcgccggtgacgacgccgcgcgtccggaatggctggagccagaatttggcgtgcgtgacggtcaatactacctgactgaacagcaggcgcaggcgattctggatctgcgtttgcagaaactgaccggcctggagcatgaaaaactgctcgacgaatacaaagagttgctggagcagatcgctgaactgctgcatattctgggcagcgccgatcgcctgatggaagtgatccgcgaagagatggagttaattcgcgatcagttcggcgatgagcgtcgtaccgaaatcaccgccaacagcgccgatattaatatcgaagatctgattagccaggaaaatgttgtcgtaaccttgtctcatcagggctatgtgaaatatcagccgttaaccgattacgaagcacagcgtcgtggcggtaaaggcaaatcagcagcacgtattaaagaagaagactttatcgaccgcctgctggtggccaacacccatgacaccatcctttgcttctccagccggggccgtctgtactggatgaaggtctatcagttgccggaagccagccgtggcgcgcgcggtcgtccgatcgttaacctgctgccgctggaagccaacgaacgtatcaccgcgattctgccggttcgtgagtacgaagaaggcgtcaacgtctttatggcgaccgccagcggtaccgtgaagaaaacggcgctgaccgaattcagccgtccgcgttccgccggtattatcgcggtaaacctcaacgacggcgacgagctgattggcgttgacctgacttctggttctgacgaagtcatgctgttctcggccgcgggtaaagtggtgcgcttcaaagaagacgccgtccgtgcgatggggcgtaccgcgaccggtgtgcgcggtattaagctggcgggagacgataaagtagtttctctgatcatcccacgcggcgaaggcgctattctgaccgtaacgcaaaacggctacgggaagcgtaccgcagcggacgagtacccgaccaagtctcgtgcgacgcagggcgttatctctatcaaagtgaccgagcgcaacggttccgttgtcggtgcggtacaggtagacgattgcgaccagatcatgatgatcacggatgccggtactctggtgcgtacccgagtgtctgagatcagcgtggtgggacgtaatacccagggcgttatccttatccgcacggcggaagatgaaaacgtagtgggtctgcaacgcgttgctgaaccggtagatgacgaagaactcgatgctatcgacggcagcgtgacggaaggggatgaggatatcgccccggaagcggaaagcgatgacgacgttgcggatgacgctgacgagtaatattattgctgtgcgagggccggatatccggccctttttcttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttattttgccgttgcgggctacgtcatttaccgctaccttagtcacactctatttacatcctgaggcggagcttcgcccctttgaaataccttgcttcctttcgaactacgctgaaagtctcgcgctacttattcagagcgttagcgttactcatttggctcttaatcgcctttgtttcggtgttttacatcgtcaatgccctgcaccagcgggagtctgaaattcgtcaggagttcaaccttagctccgatcaggcgcagcgttttatccagcgcacgtcggatgtgatgaaagagctcaaatatatcgccgagaaccgtttaacggcggaaaacggcgtcatgtcgtcgcgtgcgcgtgatgacaaaatggtggtgccggattttgaaccgctattcgccgactcagactgtgcggcgatgggctccgcctggcgcggctcgctggagtcgctggcctggtttatgcgttactggcgcgacaacttttcagcggcgtatgatcttaaccgcgttttcctgattggcagcgataacctctgtatggcgaatttcggcctgcgtgaaatgcccgtggagcgcgatgatgcgttaaaagcgttacatgagcggattatgaaataccgcaacgcgccgcaggaagaaagtgggaataaccttttctggataagccagggcgcgcgtcagggcgtgggctacttttatgcgctgacgccggtgtatctggccaatcgtctgcaggcgctgctgggcgttgagcagtccatccgtatggaaaattttttcacgcccggcagtttgccgatgggcgtcactattattgatgagaacggccattcgctgatttcgttgaccggtcctgacggcattattaaagcggagccgcgctggatgcaggagcgttcctggtttggttatacgccaggttttcgcgaactggtactcaaaaaaagcctgccgccatcctcgctcagtattgtctattctgtgcctgtagatttagtcctggagcgtattcgtattcttatcctgaacgctatcctgctgaacgtgctggtgggcgcagggctgtttacgcttgcgcggatgtatgagcggcgaattttcattccggcggagagcgatgcccagcgtctggaagaacatgaacagttcaaccgtaaaatcgttgcctccgcgccggtggggatctgtattctgcgcactattgatggtgtcaatattctgagtaacgaactggcgcacacctacctgaacatgctcacgcatgaagacagacagcgcctgacgcaaatcatttgcggccagcaggtcaactttgttgatgtattgaccagcaataataccaatttgcaaattagcttcgtccattcccgctatcgtaatgaaaacgtcgcgatttgcgtgttggtagatgtgagtacgcgcgtcaaaatggaagagtcgctgcaagagatggcgcaggcggcggagcaggcaagccagtctaaatccatgttccttgcaacggtcagccatgaattgcgcacaccgctgtacggtatcatcggcaatctcgatctgctgcaaaccaaagagctgccaaaaggcgtggatcgtctggtcacggcgatgaataacttctccagtctgttgctgaaaattatcagcgacattctcgacttctcgaaaattgagtcggaacagctaaagattgagccgcgcgaattttcaccgcgagaggtgatgaaccatatcaccgccaattatctgccgctggtggtgcgtaagcaactcggcctgtattgttttattgagcctgacgtgccggtatcgctgaacggcgacccgatgcgtttacagcaggttatttcaaacctgttgagcaacgccattaagtttaccgatattggctgcatcgtgctgcatgtgcgctgtgatggggattatctcagcattcgcgtgcgggataccggggttggtattccggcaaaagaggtggttcgcctgttcgatcccttcttccaggtgggaaccggcgtacagcgtaactttcaggggaccggtctggggctggcgatttgcgaaaaattgatcagcatgatggacggcgatatttccgtcgattcggagccgggcatgggaagccagtttacgttgcgcatcccgctttatggcgcgcaataccctgtgaaaaagagcgtggaaggactcgccggaacctgctgttggctggcggtgcgcaatacttctttgtgccagtttattgagaccagtctggcgcgtagcggcgttcatacgcagcgttatgaagggcaagaacccgccgcagacgatattttgattgtcgatgacgcgctggagcatacctggcaggggagggcggcggtcgtcttttgccgccgtcatatcgggattccattggaaagagcgcctggcgagtgggtgcatagtgtggcgtcggtgcatgagttgcccgcgctgttggcgcgtatctatagtattgagctggatagtgaagcgctttccagcgcattgccgacgacggataaaaccgcagattcaaatgacgacatgatgattctggtcgttgacgatcatccgatcaatcgccgcttgctggccgatcaactgggatcgctggggtatcagtgtaagacagccaatgatggcgtggacgctctgaatgtgctgagtaaaaatgctatcgatattgttctgagcgatgtgaacatgccgaacatggacggctatcgcctgacgcagcgtatccgtcagcttgggctgacgctgccggtcgtcggcgtgacggcgaacgcgctggcggaagagaaacaacgttgcctggagtccggtatggatagctgtttgtcgaagcctgtgacgctggatgcgttgaaacagacgctggcggtgtatgccgagcgggtacgtaaaacgcgggcataaaaaatgccggatggcggcgtcgcctgtccggcctgtaaaagatgagtcgactggtaggcctgataagcgtagcgccatcaggctgggtaacataaaagcgatttattctttgtctgtcggactcagggtgacggaagagagatagttgagcagcgcgatatcattctctacgcccagtttcatcatcgccgatttcttctggctgctgatggtcttaatgctgcggttgagcttcttggcgatttcggtgaccaggaagccctcggcgaacaggcgtaatacttcgctctcttttggcgacaggcgcttatcgccgtaaccgcctgcgctgattttctccagcagacgagaaacgctttccggggtgaattttttgcctttttgcagcgcggccagcgccttaggcagatcggttggcgcaccctgtttgagtacgatcccttcaatatcaagatccaacacggcgctcaggatcgccggattgttgttcatggtcagaacgataatagacaggctcggaaaatgacgcttgatgtacttgatcaaggtgatcccatcgccgtatttatctcccggcatggagaggtcagtgatcaacacatgcgcatctaatttcggcaggttgttgatcaatgctgtggaatcttcaaattcgccgacaacattcacccactcgatttgttcaagtgatttgcgaataccgaacagtacaatcgggtggtcatcggcaataattatgttcatattgttcatgtattgggctactttgctacagcaagcttttgacgtaggcgtcaatgtcgctgatatatttttctatacctggagcatctttctcacgaatcagatgttccagcgttacacataactgcttgccgggtaccagattaagcatggcaaacacccctttcaggcggtgggccgtttgggccagcgcagcgaaatcgctggttgccgcctcagtatacaacctcttaacatcatccggtactgtgtctacaaatagcgcataatagccgctggcatgaagctcggcattttcatctccgccgagcggggaggcgggaatctcttcctgcgccagctgctcttcgataagttgtagtacagcttcctgcatagcattgctcatattaaagttgacgcgcaactgacccgggccaattttccgcacgcctgactcatcatcgcttaaaagcaagcccgaggcagtaagattagacggattatccgttaaaaagagatcatattcttgacttatctgcctttcatccggcgtgatgcaggtggcgccccagttttctaactgacgcagcacaatcgcgcgaacctcgttggacgtcacatcgaccatcacgctcacgtcgtccagcaggcgctcttcgacctgagtatgctgatcgtgaggaagcattttgacatgaacggtatagcgcgtgcccagcgtttctcgcgctttaatgttgagatgaccgcccagtttgcgcgccagttgattgcacagccagaaggtgagcggattcgctttgccgtaacggtcgccctgcgtttcattcatatacgggaaatgcagattatcaatctcgtttaacgttacgccttcgcccgtatccagaatacggaaagtcagacgctccgcgatagattcatcctgctcgacttcaagcgtaattttacccatagcggtcgtcgtgacggcatactgaatcaacagcagcaaaatccggcgcagggcgtcgcgatcgccccagcgttcatcgttgccgctaagatggttattaatcagcagttgcagccctttacgcttaatggcgggcagcacttccggcacgacttcgtcaataagatcctgcagggagaacagcgtggtttcgcttttccatgcgtcattttccagcatattcgccagttggatttcatcgatcatacgtactaatacatccgcctgatccgccagtttcaggctttccggcgtggtgactgccgcggcgttaaccgccagttggcgtacgggctctttaagcgtgttgctgatattttgcataaaggcggcgcggccctgctgattcttctcatacaaacgctgcgcctgtttaagcttcttattcaccagcacttcccggtcctgatcgcgaataataaagatctgcgtgcggggggcgatctggctgcgaaacagacggatctcatacagttcgttattaattgtcgcctgaatcacgccctgatgctgctccgccatgctggtaatattttgcaggttaagatgcggcaacagatgatcggcgattttattgctgatcacggtgcggttgccttcctgatcgtagaccagcagacccagcggcagcagagaaacgatctcttcattaatggcgcgtaagacgcgaagctcattattcgccgcgttgccggatgtcgattccgtcgaccgtcccggctgatgacggaacgtggcgtagccaaataacgccaacgccagcagcccgatgttcagcagtaaaggcagcaaaatattttgcaacgtatcaagcaaaagcgtaccgaacggtacctgccagatcaggcgcattccggtagagttaagcgctgaggagatctcaatttttgaaccgttaaagctaatcgtgacgctatctggcgcttccttttcactgcttcgccccgtcgtctgggttgcgtcaggctctatccgaaaactgtccagcggcattcccggcgggattaaatcattaatgggcagatcaaacgccaccacggttgccagatgtcctggctgattgaaggtcgtgcgcagcgtaaaatagtgaccgttttgccaggccagttttcgcaatgaggagaaactttcgcgctcatccagcgcattcgcctgctgcaacatctctgcccggcgggaatcgacgatattgccaatagtggactctttaaagccggaagagagatctttcaacggtagggtagagataagaatcaggctgttatcctgtccgttgaggtaatacattgaccacggcacgttttccgcgccccacagcgtatccagataagttgacatacgctgcgtcatttccagcgtggcgctgtcatgggaaccgaaaatcagcgcttcagttttacgtcgcggcttttcaagataatacacatcctgtttcagacgcgtttcctgaagtccttcacctgtcgatggcgtagtggtcgcggcgatgttgtcataaatttgccaggtaacataccgccaggtgtccacgcgtttatgaatagcgtgagtgatatcgacaatttgatagcttttgtctttcaaccaggcgttgacggcgctctgtaccataacgcccatcgttaccagcagcacaatgatcagcaataagaagaaacgggtaatgcttcccggtagaagggagaatcgggtagagaccgttgtgtcagactgactcatttatgtttacgacctgtaaaagcaacgctgaaggtgaagggcagtataaagggtaatgaatgaatttccagactcttacgtcatgccgggcaacttaacacgcgctccgtcggcgggacgggaaaagcgtacaaccttcgcaaaacggtacaaatataaagactacttataaatgtttagcactaaatatcaagaaattatttgctaatgtcttatgaacggtcgagcaggggagggtagtgaataaccgtgatagttttaggcaggtagcataaatcagccgggtgtgtctgaaaaagggtaaaaaaaccgaatgtgaagcatccggttgaaataggggtaaacagacattcagaagtgaatgacggtaataaataaagttaatgatgatagcggtcactattttagttgcgaatgaagattctgttttatcattcagtgctatgaatttcatcaatttaacccgttgattttaaaagtttcgtgaatatattttgtctatttgtgcttatttttacttgatttttgctttaaaaaagttccgtaaaattcatattttgaaacatctatatagataactgtaacatcttaaaagttttagtatcatattcgtgttggattattctgtatttttgcggagaatggacttgccgactggttaatgagggttaaccagtaagcagtggcataaaaaagcaataaaggcatataacagagggttaataacatgaaagttaaagtactgtccctcctggtaccagctctgctggtggcgggcgcagcgaatgcggctgaaatttataacaaagacggcaacaaattagacctgtttggtaaagttgatggcctgcactacttctctgacgacaaaggcagcgacggcgaccagacctacatgcgtatcggcttcaaaggcgaaacgcaggttaacgatcagctgaccggttatggccagtgggaatatcagattcagggcaaccagactgaaggcagcaacgactcctggacgcgtgtggcgtttgcgggtctgaaattcgctgacgcaggttccttcgattatggtcgtaactacggcgtaacctatgacgtgacctcctggaccgacgttctgccggagttcggcggcgacacctacggcgctgacaactttatgcagcagcgtggtaacggctatgctacctaccgtaacaccgacttcttcggtctggtggatggtctggacttcgcgttgcagtatcagggcaaaaacggcagcgtgagcggtgaaaacaccaacggtcgcagcctgctgaaccagaacggcgacggttacggcggatcgctgacttatgcaatcggcgaaggcttctctgtcggtggcgctatcaccacgtctaaacgtactgccgatcagaacaacaccgctaacgctcgcctgtatggtaacggcgatcgcgccacggtttacaccggcggcctgaaatacgatgcgaacaacatctatctggcagcgcagtattctcagacctataacgcaacccgttttggtacctctaacggcagcaacccgtccacctcttacggttttgccaacaaagcgcagaactttgaagtggttgctcagtaccagttcgactttggtctgcgtccgtctgtggcttacctgcagtctaaaggtaaggacatcagcaacggctacggcgccagctatggcgaccaggacatcgtaaaatacgttgatgtcggcgcgacttactacttcaacaaaaacatgtccacctatgttgattacaaaatcaacctgctggataaaaacgactttacccgcgatgcgggcatcaacaccgacgacatcgtagcgctgggtctggtttaccagttctaatcagcaaaagatgttgctaaagggcctgcgggcccttttttcatgccttattccggcgtacaaatacgacgttttgatatacgcttgcgtccattcgaatgaggataaacagcgatgaaaatgactttttgccgggccgtgtgtctggcagcggcttttttacttatgggctgcgatgaggctcccgaaacgacaacagcgtcacctgccgctcaggtgctggaaggtaaaacgatgggaaccctctggcgggtgagcgtggttggtatcgatgcgaaacgtgccgcagagttacagactaaaatccagactcagcttgatgctgatgattggttgctttctacctataaaaatgactccgcgctgatgcgttttaaccattcacgcagtcttgcgccctggccggtcagcgaagccatggcggatatcgtgacctcggcgctgcgtattggcgcgaagacggacggcgcgatggatatcaccgtgggcccgctggtcaatctgtgggggtttggaccggatcggcagccgctgcatatcccaacaccagcacaaatcgatgcggcaaaagcgaaaacaggcctgcaacatttgcaggttatcgacagggctggacatcagtttttgcaaaaagatctgccggatctttatgttgatctctccacggtcggggagggctatgcggcggatcatctggcgcgtctgatggagcaggagggcattgcgcgttatctggtctcggtgggcggcgcattaagcagtcgcgggatgaatgcgcaggggctgccgtggcgcgtcgcgattcagaagccgaccgaccgggaaaacgcggtgcaggcgattgtggatatcaacgggcatggcatcagcacctccggcagctaccgtaactattacgagctggatggcaagcgcgtatcgcacgttatcgatccgcaaacggggcgccccattgaacacaatctggtatcggttacggtcatcgcgccaacggcgctggaagcggacggctgggacaccggcctgatggtgctcggtacgcaaaaggcgcaagaggtcgtgcggcgggaagggctggcggtctttatgatcatgaaagaaggtgaaggctttaaaacctggatgtcgccgcagttcaaaacattcctggtgagcgataagaattaaaacgcaagattacgggtttttgtgggcggatttacggacacactgcatgtaagcaagcactatgcttaatgaaggagtctatgatgaaaaaagcgttacttaccgatgatgaatgctggctgcgggtgcaggcgcgcgatgccagcgcggatgggcgtttcgtttttgcagtgcgaaccactggcgttttttgccgcccttcttgtcgctcgaagcgggcgttacgtaaaaatgttcgcttttttgccaacgcgcagcaggcgctggacgccggttttcgcccctgcaagcgctgtcagccggataatgcgcgcgcgcagcaacggcggttggataagattgcctgcgcctgccgtttacttgagcaggagacgccggtaacgctggcgtctctggcgcaggcggtggcaatgagtccgtttcatctgcaccgtttgtttaaagcgagcaccggaatgacgccgaaagggtggcagcaggcgtggcgcgcccggcggctgcgtgaggcgttggcgaaaggagagccgatcacggcggctatttaccgcgccggcttcccggatagcagtagctactatcgtcatgccgaccagacgctgggcatgacggcaaaacagtttcgcaaaggcggcgataatgtctccgttcgctatgcgctgacggactgggtttacggacggtgcctggtggcggagagcgggcgggggatttgcgcgattctccccggtgatagcgacgatgcgctactggccgaattacacacccttttcccggcggcccgccacgaacctgctgacgcgccttttcagcaacgggtgcggcaggttgccgcggctatcaacacacgcgatgtgctgctctcgttgccgctggatatccagggaaccgcgtttcaacagcaggtctggcaggcgttatgcgcgattccctgcggcgaaaccgtaagctatcaacagcttgccgcgactatcggcaaacccacggcagtacgcgcggtcgccagcgcgtgcggcgcgaataaactggcgatggtgatcccgtgtcatcgggtcgtgcgtcgcgatggcgcgctctccggttatcgttggggcgtgcgtcgaaaagcgcagctattaaagcgagaagcgcaaaaagaggagtagcaatgctggatctgtttgctgatgaagcgccctggcaagagcccctggcgcctggcgcggtggtgttgcgccgctttgcgtttcgcgcggcgcagtcgctattagacgatatcggatttgtcgccagtcagtcaccgtttcgtcagatggtgacgccgggcggctacactatgtcggtggcgatgaccaactgcggcgcgttagggtggaccaccgatggtcacggttattgttatgccgtgcgcgatccgttgaccgataaaccctggcctgtgctgccgttatcgtttgccagcgtatgtcgtcaggcggcaatcgcggcagggtatgctagcttccaaccggacgcctgcctgatcaatcgctacgcgcctggcgcaaaactgtcgctgcatcaggataaagacgagccggatctgcgcgcgcctatcgtctcagtttcgttgggggtgccggcggtttttcagtttggcggcctgcgtcgcagcgatccgctccagcggatcttactggagcatggcgatatcgtggtctggggcggcgagtcccgcctgttttatcacggtatccagccgcttaaagcgggctttcatcccatgaccggtgaatttcgttacaatctcaccttccgtcaggcggctgaaaaagaataaaaataagaattattattgctgtgcaggtagagttagttaaactgcgggctgttattatcggtccgggttgtatgcatggaacttcttattcttgtctggcggcagtaccgctggccatttattagcgtgatggcgctgagcctcgccagcgcggcgctggggattggcctgatcgcgtttatcaatcagcgcctgattgaaacggtggacaccaccgtcatggtgctgccggaatttctcggtctgctcctgttgctaatggttgtcacattaggttcccaactggcgctcaccgctctgggacaccatttcgtttaccgcctgcgcagcgaatttatcaagcgcattctggatacgcacgttgaacgcattgagcaactgggcagcgcctctttactggccggtctgaccagcgatattcgcaatattactatcgcctttgtgcgtctgcctgagctggtgcagggcattgtcctcaccgtcggctcggcggcgtatctggcgatgctatcgacaaaaatgctgctggttacggctatctggatggcggtcactatctggggcggattcgtgctggtggcgcgggtttaccagcatatggcgaccctgcgcgagaccgaagataagctgtacaacgactatcagacggtgctggagggacgcaaagagctgacgctaaaccgcgagcgtgcggagcagatttttcagcaatgctataccccggacgccaaagagtaccgtcatcacattatccgtgccgatacttttcacctgagcgccgtcaactggtcgaatatcatgatgctgggggcgataggcctggtcttctggatggcgaatagtctcggctgggcggataccaacgtcgcggcgacctattcactgacgttgctgttcctgcgcacgccgctgctgtctgcggtgggggcgttgccaacgctactgaccgcccaggtggcgtttaataaactgaataaattcgcgctcgccccgtataagcctgattttccacagccgaaagcctttcccgactggaagacgctggagctgcgcaacgtggtttttcactatcaggataacgcgttttccgtggggcccatcaacctgacgattcaccgcggcgaactgctgtttttaattggcggcaacggtagcgggaaatcgacgctggccatgttattgaccggtttataccagccgcaatcgggaacgattttacttgacggtcaacctgttgccgccgggcagccggaagattatcgcaaactgttttctgcggtgttcaccgatgtgtggttattcgaccgcctgctggggccgcaggggaaacccgccaatcccgcgctggtcgaaaagtggcttgagcacctgaaaatgacgcacaagctggagctaaacgatgggtgcatcttgaatcttaaactgtcgaaagggcaaaaaaagcgcattgcgctgctgctggcgctggcggaagagcgcgatattattttgctggatgagtgggccgccgatcaggacccgcatttccgccgggaattttatcaggtactgttgccgttaatgcaggaaatgggcaaaaccattttcgccatcagccatgatgatcactattttattcacgccgatcgcctgcttgaaatgcgtaacgggcagttaaccgaactcaccggcgacgaacgtgacgccgcttcgcgtgatgcggttgcgcgtactgcgtaatggactatggcgccggataaactgcctgatggcagccctacgtccgcacgcgggtaggcctgataagatgccacgcgtcgccaccaggcatcggggtattttttgcggcgggcgagcgggtttccagacgtgttttaaaaagaaccccggagcgctgcgtgagtcggcgtgttcagatgcccggtaagtgtgaccgggcagcgtaacattatcgcgcgatggcattctgtacgttagcgtccgctttccagatgcggtatttcacgtccacattcgccggggtatacaccacgatcggcagcttgctgttgtagcgcagcatcccgtcttcacccagccaggcggtgacgaatttttgctctttcttaccttcagggcaggccatcatggttgataccggagaggtgacgttatcaaagacataatagtcgtagccccagccttccagcgtttttgtttccagcgtgccgccgaggcgatgctggttacaatccacattcagcgtttgaccaatcaacagttccactttgagggtagattcatcctgctgaggggtaagggttatcacttgccgcttcattcctttctccgcctgcggatagggggcgattttttccagcggctgggcggtatcgccattgttagcccaggcagaggcgctggcgagggcggcgaagacgacggcagggacaaacatcttcatttgattgttcacagtatttcctttctgctgttttcggtatgcacagacaacagattaacacattcatattatctattaatctgtatttactcatattttcaagattattaataaaataacgtctttttatatagtggaatattctgatattgataatgtaaatgaaattatcagctattagtgatttccgttatataaatatctatataactcattgaaatgtgagaaaaagcacgtttacgggtctttacccggcactcttttgatccggcaacagcatttacctctatcggggtatgcatctcttacacatcctgaaatatcttatttacaaaaataactactcataaattgtacggtttttattggcattcactccctatggaagcgtgtcgttatggaagggcgatatcatggttgatttatcccgtcgaagcatgttgaccggcagttggcgcaacgccagcaatgggattcttccgccgtgggccagagaaacgacctattttctcgcacattgtctgcgttgcgacgcctgcatccaggcgtgtgaggccgacatcctgcagcgagggacggggggatatccgagcgtaaatttcaaacggggcgagtgcagcttttgttatgcctgtgcgcaggcctgtcccgaatctctctttcttccgcgccgcaccagggcctgggatctgatttttacactcacggaaaactgcctcgccaggcagtcggttgaatgccatcgttgcctggacagttgtgaacctatggccattacctttcgtcccacgttatccggtatttaccagccgcagcttgactcgcaggcctgtaacggatgcggggcgtgtgtggctatctgtcccgtgtcagccatcaaagcggagaaccaccatgcgcactaactggcaggtctgtagcctggtcgtgcaggccaaaagtcagaacatcgccgccattggcacacagttgaacacgttgccgggttgcgaagtcgcgttaagcgacgttgaaagcgggcaactgatcgtggtggcggaagcagaccagagtgaaacgctgatgcaaacaattgagtcagtacgcaatgtcgagggcgtgctggcggtgtcgctggtttatcaccagcaggatgagcaaggtgaggaaacaccatgaaactcagtcgtcgtagctttatgaaagctaacgccgttgcggccgctgcggcggctgccggtctgagcgtgccgggcgtcgcccgcgccgttgtcgggcagcaggaagctatcaaatgggataaagcgccgtgccgtttttgcggaacgggttgcggtgtgttggtgggaacgcagcagggccgtgtggtcgcctgccagggcgaccccgacgcgccggtcaaccgtggtctgaactgcattaaaggctacttcctgcccaaaatcatgtacggtaaagatcgtctgacgcagccgatgctgcgcatgaaagacggcagctatcacaaagacggcgagtttacgccggtgagctgggaacaggccttcgatgtgatggaagagaagtttaaaaccgccctgaaagagaaaggaccagaagcgatcggcatgtttggatcgggtcaatggaccatctgggaaggctatgccgccgcgaaactgttcaaggctggtttccgctctaacaacatcgacccgaacgcgcgtcactgcatggcctcggcggtggtgggctttatgcgcacctttggcatggatgaaccgatgggctgctacgacgatattgagcaggccgatgcgtttgtgctgtgggggtccaacatggcggagatgcacccgattttatggtcgcgcatcactaaccgccgtttgtccgacccgaatgtgaaagttgctgtcctctccaccttccagcaccgtagctttgagctggcggacaacggtattgtctttaccccgcaaagcgatctggtgatccttaactatatcgcgaattacattattcagaacaacgcggtaaatcaggatttcttcacaaagcatgtgaatctgcgtaaaggggcgacggatatcggctacggcttacgcccgacgcacccgctggaaaaagcggcgaagaatccgggctccgacgcttccgagccgatgagcttcgacgagtataaagccttcgtggcggaatatacgttggacaagactgctgaaatgaccggcgtgccgaaagatcaactggaacagttggcacagctctacgccgatccgaataagcgcgtgatctcttactggacgatgggttttaaccagcatacccgcggcgtgtgggcgaataacctggtttacaacctccatctgctgaccggaaaaatctcccagcctggctgcggtcctttctcgctgaccggccagccttccgcctgcggtacggcgcgtgaagtgggaaccttctcacaccgtctgcccgcagacatggtcgtgacgaacgaaaaacaccgtgatatctgcgaaaaacactggcagatccccgctggcactatcccggcaaaagtgggtttacatgcggtggcgcaggatcgcgcgttgaaagacggcaagctgaacgtctactgggtaatgtgtaataacaatatgcaggccgggccgaacatcaatgaagatcggatgccgggctggcgcgatccgcgtaactttatcattgtctccgatccttacccgacggtgagcgcgctgtctgctgatctgatcctgccgaccgccatgtgggttgagaaagaaggcgcttacggcaacgccgaacgccgcacgcagttctggcgtcagcaaattaaagcgccgggcgaagccaaatccgacctctggcaactggtgcagttctcccgtcgttttaaaaccgaggaggtctggccggaggcgttgttggcccagaagccggagctgcgcggcaaaacgctgtatgacgttctattcgccacgcctgcggtcagcaaattcccgctgagcgagctgaaagaagatcagttaaacgatgagtctcgtgagctgggcttctatctgcaaaaagggctatttgaagaatacgcctggtttggacgtggccacggtcacgatctggcgccgttcgacgattaccacaacgcgcgcggtctgcgctggccggtcgtcgaaggcaaagagacgcaatggcgttacagcgaaggcaacgacccgtatgtaaaagcgggggaagggtacaaattctacggtaaaccggatggcaaagcggtgatcttcgcgctgccatttgaacccgcggcggagtcgccggacaacgagtacgatctgtggctttccaccggtcgcgtactggaacactggcataccggcagtatgacgcgccgcgtgcctgaattgcatcgcgccttcccggaagcggtggtctttattcacccgctggatgcgaaagcgcgcgatctgcgtcgtggggataaggttaaagtgtcgtcccgccgcggcgaagtgatttcgattgtcgaaacgcgtggacgtaaccgtccgccgcagggactggtgtatatgccgttcttcgatgccgctcagctagtgaacaacctgacgctggatgcgacggacccgctctctaaagagacggacttcaagaagtgcgccgttaagctggcgaaggtgtaacgcgttatgtcccgtacagcgaaaccccaaaatggccgccgccgctttctgcgtgatgttgtgcgcactgcgggcgggctggcggcggttggcgtggcgctgggcttgtaacagcaaaccgcgcgcgcaacgggcgtgcggctgcgtccgcctggcgcgctgaatgaaaatgttttcgccagcgcctgtgtgcgctgcgggcagtgcgttcaggcgtgtccatacgacacgctaaaactggcgacgctggcctccgggctatcggcaggtacgccctatttcgtcgctcgcgacatcccctgcgaaatgtgtgaagacattccgtgcgccaaagtctgccccagcggggcgctgaataaagatatcgcctccattgatgactcgcgcatggggctggcggtgctgctggatcaggaaaactgcctcaactttcaggggctgcgctgcgacgtttgctaccgcgaatgcccgaaaatcgatgaggccatcacgctggagctggatcgcaacatgcgcactggcaaacatgcgcgctttctgcccaccgtacacagcgacgcctgtaccggctgcggcaaatgcgaaaaagtctgcgtactggagcaaccagcgataaaagtgttgccgttgtcattggcgaaaggggagttaggacaccattaccgcttcggctggctggaggggaaagatggcaaatcgtaaacgcgacgccgggcgagaagcgcgggcgaaaaaaggctggtggcgtagccaccgttggctggtgttacgccgtatcagccagtttatggtgctggggatgtttctcagcggcccgtggctgggcttttgggttttgcatggcaactacagcagtagtttgctgttcgataccctcccgttgaccgatccgctgattaccctggaaagtctcgccagtggacatcttcccgctaccgtggcgctgacgggagcagtgattatcgctgtgctgtatgcgctggcgggaaagcgattattttgcagttgggtttgcccgctaaaccccgttaccgatttggctaactggatgcgcaggaaatttgacctgaaccagtcggcgacgattccacgccatatacggtatgtccttctggtggtggtgttaatcggttcggcgttgaccggcacgctgctgtgggaatggattaatcccgtgtcgctgttaggtcgtagtctgattatgggatttagtagcggcgcgttgctgattattgctttgtttttatttgatttattagtcgttgagcacggttggtgcggtcatatttgcccgatgggcgcgctgtatggcgtgctgggcagtaaaggcgtagtgaccgtgacggccaaaaaacgtgagaaatgtaatcgctgtatggattgttttcatgtttgcccggaaccgcatgtgctacgtgcgccggtgctggatgagcaaagcccggcgcaggtcactcaccgcgactgcatgacctgcggtcgctgcgtggatgtctgttctgaggatgtttttacaataacgatacacaacatcattcgggatgcatcgcggcggtaagcgaggaaatccccgggagcatagataacgatgtgactgggattttcgagcgcagccaacaaagaggcagctcgaaggatgaagtgtaaatgcgatggagttcgggagcgaaacaatgaaaagccatgacctgatgaaagcgctgtgtcaatggatggccacgcttgccctggtggtaagtggtgcggtttgggcggcaaacggagtggatctgagccagtcgccggaagtatccgggacgcaggaaggggcgattcgtatgccgaaagagcaggaacgtatgccgctaaattacgtcaaccagccgccgatgatcccgcacagcgtcgagggctaccaggtgacgaccaataccaaccgctgtctgcaatgccacggcgtggaaagttatcgtacgacgggcgcgccgcgtatcagtccgacgcactttatggacagcgacggtaaagtgtcgggcaacgtcgcgccgcgtcgttatttctgcctgcagtgccacgtaccgcagtctgataccgcgccgattatcgacaatacctttaccccctcgcaaggttacgggaaataagaggtcattatggaaaattctaaccgtaaacttggctggataaagcgcgtctggcgatggtggcgcagccccagccgcctggcgctggggacgctgctgttaatcggttttatcggcggcgtcatcttctggggcggcttcaataccggaatggaaaaggctaataccgaagagttttgtattagctgccatgaaatgcgcaacacggtgtatgaggagtatatggaaaccgtccactacaacaaccgtagtggcgttcgcgccacctgtcctgactgccatgtgccgcatgagtgggggccgaagatgatccgtaagatcaaagccagtaaagaactgtacgcgaaggtatttgggctgatagatacaccgcagaaatttgaagctcatcgcctgacaatggcacaaaatgagtggcggcgcatgaaagacaacaactcgcaggaatgccgtaactgccacaatttcgactttatggatctgaccgcgcaaaaaggcgtcgcggcgaaaatgcacgatcaggcggtaaaagatggacagacctgtatcgattgccacaaagggatcgcgcataaactgccggatatgcgtgatgttaaaccaggtttctgacaggacgttgatgagtgggaatgcttgaagccagagatctgtactgcgagcgggacgagaggacgctgtttcgcgggctgtcgttcaccgtggaggccggggagtgggtgcaggtcaccggcggcaacggcgccggaaaaaccaccctgctgcgcctgctgaccgggctggcgcgcccggacggcggggaggtgtactggcagggcgagcccctgcgccgcgtgcgcgacagcttccatcgcagcctgctgtggatagggcaccagccggggataaaaacccgcctgacggcgcgggagaacctgcactttttccaccccggtgacggcgcgcgtctcccggaggcgctggcgcaggccgggctggcgggatttgaggacgtgccggtcgctcagctctcggccgggcagcagcgccgggtggcgctggcccgcctgtggctgacccgcgccgcgctgtgggtgctcgacgagccgttcaccgccattgacgttaacggcgtggcgcgcctcacccggcggatggcggcgcacacggcgcagggcgggatggtcatcctcaccacccaccagccgctgccgggggccgcggacaccgtccgccgcctggcgctgaccggcgggggggccgggctgtgatgtggcgtgtcttctgtctcgagctgcgcgtggcgttccgccacggcgcggacatcgccggcccgctgtggttcttcctgatggtcatcaccctgtttccgttaagcgtcgggccgcagccgcagctgctggcgcgtatcgcgccgggcatcatccaggtggcggcgctgctggcctcgctgctggcgctggagcggctgtttcgcgacgacctgcaggacggcagcctggagcagctgatgctgctgccggtgccgctgccggcggtggtgctggcgaaggtgctggcccactgggcggtgaccggcctgccgctgatgatgctctccccgctggtggcgctgctgctggggatggacgtgtacggctggaaaatcatggcgctgacgctgctgctcggcacgccggcgctggggtttctcgccgcgccgggcgtcgggctgacggccggcctgcggcgcggcggcgtcctgctgggcattctggtgctgccgctgagtgtcccggtgctgattttcgccaccgcggcgatggacgcggcatcgatgcatttacccgttgacggctatctggcggtgctgggggcgctgctggcgggcagcgcgacgttaagcccgttcgccaccgcggcggcgctgcgcatcagtacgcagtagcgccccggcacgacggacattttactggtttcaggaggtcaggtgacgactatgtggaaaacccttcatcagctggcggcgccgccccggctgtatcagatttgcggcaggcttgtgccgtggctggcggcagccggcatcattgtgctggccacgggctgggtccggggctttggtttcgccccggcggactaccagcagggggagagctaccgcattatgtacctgcatgtcccggcggccatctggtcgatgggtatctatgcggcgatggcggtggcggcgttcaccgggctggtctggcagatgaaaatggccagccttgccgtcgcggcgatggcgccggtgggggcggtgtacaccttcatcgcgctggtcaccggcgcggcgtggggcaaaccgatgtggggcacctggtgggtgtgggacgcgcgtctgacctcggagctggtgctgctgtttctctatgccggggtcatcgccctgtggcacgcctttgacgaccgtaaaatggccgggcgcgcggcgggcattctggtgctggtcggcgtggtgaacctgccggttatccactattccgtcgagtggtggaacaccctgcaccagggctcgacgcggatgcagctgagtatcgacccggcgatgcgctcgccgctgcgctgggccatcgccggcttcctgctgctctttatgacgctggcgctgatgcggatgcgcaacctgattttactgatggaaaaacgccgcccgtgggtgagcgaactgatactgaaaagggggcaccggtgagtccggcattttcatcgtggagcgattttttcgccatgggcgggtacgccttttttgtctggctggcggtggcgatgaccgtggcgccgctggcgctgctggcgctgcacacggtgctgcagcgccgggccattctgcgcggcgtggcgcagcagcgggcgcgcgaggcgcggatgcgtgccgcacaggcgcaacaggaggccgcgtgaatctgcgacgtaaaaaccggctatgggtggtctgcgcggtgctggcgggcctggcgctgaccaccgccctggtcctgtacgcgctgcgcgcgaatatcgacctgttctatacccccggcgaaatcctctacggcaagcgcgagacgcagcagctgccggcggtgggccagcgcctgcgcgtcggcgggatggtgatgcccggcagcgtcaggcgcgacccggactcgctgaaggtgaacttcagcctctacgacgccgaagggtcggtgacggtgagctatgaggggatactgccggacctgttccgcgaggggcagggggtggtggtgcagggcaccctggagaagggcaaccacgtcctggcgcacgaggtgctggccaagcatgacgagaactacaccccgccggaagtggaaaaggcgatgcaggaaaaccaccgccgcccgcaacgcgctgataaggacacttcatcatgatgcctgaatacggccacgcactgctgtgcctggcgctcggcgtggcgctgctgctgtccgtttacccgctgtggggcgtggcgcgcggcgacgcgcggatgatggcgtcggccggggtgttcgcctggctgctgttcatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgtttgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgttgtccatctgcgccttctcgctgtgtctgctgggcaccttcctggtgcgctccggggtgctggtgtcggtgcacgccttcgcctccgacccggcgcgcggaatgtttatcctcgcctttatggtgctggtcaccggcggctcgctgctgctgttcgccgtgcgcgggcacagggtgcgttcgcgggtgaacaacgcgctgtggtcgcgtgagtcgctgctgctcggcaacaacgtcctgctgatggccgccatgctggtggtgctgctgggtaccctgctgccgctggtgcacaaacagctggggctgggcagcatttcggtgggggagccgttctttaacaccatgttcacctggctgatggtcccctttgccctgctgctgggggtggggccactggtgcgctggggccgggaccggccgcgtaacatcaggaaactgctgctcaccgccctggtctccaccctggtgctgtcggtacttttgccatggctgctggaagatagaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggtatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccggggggctgctgatggcgctgggcgggctgctgtgcctggcggacccgcgctaccgccgccgtaaaccattgccggaggccggatgaaacgcaacgtactgttattaccgctgctgatttttctgctgattgccgcggcgctgctgtggcagctggcgcgcaacgcgcagggggatgacccgacgaatctcgaatcggcgctgaccggaaagccggtgccggcgtttcgcctggaatcgctggagacgccgggtcagtactatcaggcggaggtgctgacgcaggggaaaccggtgctgcttaacgtctgggccacctggtgcccgacctgccgcgccgagcatcagtacctgaaccggctggccgcgcagggtatccgggtggtggggctgaactataaggacgaccgggcgaaggcggtggcctggttaaaggaactgggcaacccgtatgcgctgagtttatcggacagcgacgggatgctggggctggacctgggcgtgtacggcgcgccggaaaccttcctcatcgacggcagggggattatccgctaccgccatgcgggcgatttgaatgcccgggtatgggaaagtgaactgaaaccgctgtgggacagatacagccgggaggcggcgcaatgagactgttaccgggcatggtgatgctgatgctggcgctggttatctccgggtcagcgcgggcgaccaccgacgtgatgccgtttaaagatgaagcgcaggagcagcagttccgccagctcacggagcagctgcgctgcccgaaatgccagaacaacagcattgcggactcgaacgcgatgatagccaccgacatgcgccgcagggtgtatgacctgatgcaggaggggaagagccgccaggaaatcatcgattacatggtggcgcgctacggcaacttcgtcacctacgacccgccgctgaccccgctgacggtgctgctgtgggtgctgccgctggccgccatcgtggcgggcgggtggataatcgtcgcccggacgcgccggcgggtgcgcctgcgccgggagccgctgccggcggacaccccggtttgcggcgcgcgcgccgggtggggcgtttacgtgccgggggccgtcattgcgctggcggtcggcgccggcagctacgccctgaccggcagctatccgcaggtgagggcctggcagcaggcaacggcgcagacgcccgggctgctggcgcgggcgctggacccgcaggcgcagccgctgaatgaggaggagatggcgcggctggcgctggggctgcgcacccgcctgcagaatgatgccggcaatgttgagggctggctcatgctggggcgcaccggtatggtactgggtaatgccggtaccgccaccggggcgtatgcgaacgcttaccgtctggacccggaaaaccgcgatgcggcgctgggctacgcggaggcgctgacgcgctcgtccgacccggaggataaccgccgcggcggggaactgctgcgtcagctggtgagccgcgaccacacggatatccgggtgttaagcctgtatgcgttcagcgcctttgagcagcagcgctttggcgaggcggtggcggcctgggagatgatgctgaagctgctgccggcgggtgacgcccggcgggcggtgatagagcgcagtatccggctggcgcaggagaaataagaccctgacggcccggtggcgtggcgccaccgggcctggcttgttactgcattccgcgtgtttgtaaaaatagaatggtcgccgcgacgcgcgagcgcacgtttagcttgcgaagtagattacgaatgtgcaccttaaccgtctgctcagaaatattcagtactgacgcaatctgtttgttagaaagcccctgcgccagctcatgcaagacatctaactctcgttcggtcaggatactaaagggatcttcctgcgcgccaaaccgttcacgctcacgcagatattcattgacccgatcgctaaagactttaccgccgttagcgcctttgcgaatggcctccagcagcacttccggatcgctatctttgagcagataaccgtcggcgccggcgtcgatcagcgcgtagatgtcgctggcggaatccgagacggtaagaataataatttgcgccgtcacaccatcccggcgtagcgcgttcagggtatctaacccgctcagacctttcatattcagatccagcaggatcagatcgggctcaatgcgattcgccagatcgatcgcactcgccccgtcacccgcttcggcaacgacataaaaagccgggtccagttccagtaattgacgaatacctcgccgcataagtggatggtcgtccacaataagcacctgaaaaggtgttacttcaggcatgctatatctcctgagttttattagaatgattattgttttcagcgcggaaatcgtccagatttgccacattgtcaagcgcgtaaattttaccttaattagtgcatgggtaagtagtaaaacctgtgacaggcgagtcattagctgaacgatagaaaggataaaacaacctgttgtgagagaaaacagaatactccctgaagttgaatactggtctggacgcttttttcggacaatgtgacataacagaagtgtggcatatgtagctgcgcccttgcgtccgtaagtccagactatctttactggcaggaaattccttattaaaagtcatagcgtctaaagattttcattattaacaaattattttaattgaatttatttatggttttattaatgccaatgaaatacatctgagcagaacgaataaaccgcgacatctgttaaattaaatattaagtcaatagcagaggtatttttatgcgataaagagattctgacgatattcttatcataaatgaaaatgtggtcaggaatgagcgtcattcacttataacttatcctggatgtgcctgaacaacactcgcggcgttttgagcacccgttggggcgactcaaggggagaacgtagtgtggatgctatatcagccgtttctgtgagcgtaagcgtggcgtagaaaattttaaatatgttagccggttaaaaataactattgacattgaaatggtggtggagtgtatatgaagagaatatttatatatctattattaccttgtgcattcgcatgttctgctaatgataatgtttttttggcaagggcaacaagcatcagatctcttttgctgcgggagaaagtataagaagaggaggggttgagcacttatatacggcttttctgacatacagtgaacccagcgattttttctttttacaggcaagaaataatctggagttaggaggatttaaggctaagggtagcgatgattgcagtaaacattctggcagcgttccctgtaataaatataaccagggcgtattgggtatctcgaaggatgtggcgctggttcatttcgctggtatctataccggtattggtctgggggcttatataaaatctaagtcgcgagatgatatgcgtgtcaattctgcatttacctttggagaaaaagcgtttcttggctggaactttggggctttttctacagaagcttatatccggcatttctcgaatggatcacttacggataaaaattcagggcataattttgtaggtgcttcaattagttataatttttgaagttgaataacaattagcgagttgctggctgaaggagtaattaatcaccgtacgttgtctacaaaacgtgttgtgaatagccgatcgttatcgaccctatggcgacagggaggctaattgttagcgacaaaggcgtggtaggccgtttaccttaccagaacgttttattattgctgcgacagattgcttactcatttacctgccactgcaaacattttttccagtatagggtgtagatgcgctttttctgttttagtacaaacatggtttacgttagttgcctgcattgactttactgtgaccactgcacaggaaagatgtccaatcagttcatgcaaaatcagttcatgcaaaataacgtctctggcatcagctaactttttaattgtaggcataaaaaaaccagccctgacaggctggttttcaaggggaattttggtcggcagcttcatccgcagcatctgcggagagcagcgcaggtacggcgaccacaaaagccggggaggcatcagccagcgcggcgtcggctgacacagccagaacggcggcagccgcctcgtcatcagcatcgtaggcatccacccacgccgccgcatctgataccagcgcatcactggcagcgcaaagcagagctgcagccggagaatcggcaaccagagctgaagaggccgcgaaacgggccgaggatatcgcagacgtgatttccctggaagatgcaagcctgacgaaaaaaggtatcgttaaattaagcagtgccacggacagtgacagcgaagcgctggcggccacaccaaaggcggtaaaaaccgttatgggtgaggtacggaccaaagcgccgctggacagcccggcattcactggaacgccgaccacaccgacgccgccaggcgatgctaaagggcttcagacaacaaacgcggagtttgtccgcaaactgattgccgcgctggttggttccgtactggagccactggacaccctgcaggaactggctgacgcgttgggaaatgatccgaactttgccaccacggtactgaataaactggcgggcaagcagccgctggacgaaaccctgacggcgctgtcaggaaaaagcgttgacggtcttatcgaatacgttggtttgcgagaaaccataagtcgtgccgccgatgcattacaaaaatcacagaatggcggcgatattccggacaaggatttgtttgtgcgtcgtatcggtgccgcgcgagcgtttgatggcgcagttattatcggctgtgatgataatccgtggacgacggcggagtttatcgtctggctggagtctcagggcgcattcaatcacccttactggatgtgtcgtggctcctggtcttacgcttataacaaaatcatcacggatactggctgcggtaatatctgtctcgctggcgcagtgattgaggtaatgggagtgcgtggcgcgatgactattcgggtgacaacgtcccattcagtatctggttggtgatacgtgggtgacagccccaagtgtataagaaggaataattatgacagcggaaaaaaaataaaaagaacaaacagtttttaaatattaaaaatttcattccgtatgcaccggaaccagatgacacattattcgccgatgcggcgtatcttaaatcagaggatggtcaggactggtatgggtgccagcaattattttcagcagacacgctgaaaattacctacgacgataacgatgttattacgtgtattacgcgtgatgtttccgggctgtggcctgctggccagagcgttgcagagttgcctgatacggatgaaaaccgtcgcgctgatattcatgctgctggcagtttaaagacggtaaagtcgttcaaagggtttattcgccggaagagctgcgcaggcaggcagaatcgaaaattgaacgcccgggcgttgataccggatgatctggtcatcgtggaaagcgaccctgaaaaaatcgacactttagctgtaaaatgacagtcccgccatccggtcatcataacggatttttcttctgcaccttctgaagcccgccatgtcaggacgaccatgaatccgccgataaccttattgtgaaattaagaccaggaagagatgatgtctgccggacagatactatatgtaaatttataaaggttttttgttatgccctttcatattggaagcggatgtcttcccgccaccatcagtaatcgccgcatttatcgtattgcctggtctgataccccccctgaaatgagttcctgggaaaaaatgaaggaatttttttgctcaacgcaccagactgaagcgctggagtgcatctggacgatttgtcacccgccggccggaacgacgcgggaggatgtgatcaacagatttgaactgctcaggacgctcgcgtatgccggatgggaggaaagcattcattccggccagcacggggaaaattacttctgtattctggatgaagacagtcaggagatattgtcagtcacccttgatgatgccgggaactataccgtaaattgccaggggtacagtgaaacacatcgcctcaccctggacacagcacagggtgaggagggcacaggacacgcggaaggggcatccgggacattcaggacatccttcctccctgccacaacggctccacagacgccagcagagtatgatgctgtctggtcagcgtggagaagggctgcacccgcagaagagtcacgcggccgtgcagcagcggtacagaaaatgcgtgcctgcctgaataatggcaatgcagtgcttaacgtgggagaatcaggtcttaccaccttgccagactgtttacccgcgcatattaccacactggttattcctgataataatctgaccagcctgccggcgctgccgccagaactgcggacgctggaggtctctggtaaccagctgactagcctgccggtgctgccgccaggactactggaactgtcgatctttagtaacccgctgacccacctgccggcgctgccgtcaggactatgtaagctgtggatctttggtaatcaactgaccagcctgccggtgttgccgccagggctacaggagctgtcggtatctgataaccaactggccagcctgccggcgctgccgtcagaattatgtaagctgtgggcctataataaccagctgaccagcctgccgacgttgccgtcagggctacaggagctgtcggtatctgataaccaactggccagcttgccgacgctgccgtcagaattatataagctgtgggcctataataatcggctgaccagcctgccggcgttgccgtcaggactgaaggagctgattgtatctggtaaccggctgaccagtctgccggtgctgccgtcagaactgaaggagctgatggtatctggtaaccggctgaccagcctgccgatgctgccgtcaggactactgtcgctgtcggtctatcgtaaccagctgacccgcctgccggaaagtctcattcatctgtcttcagagacaaccgtaaatctggaagggaacccactgtctgaacgtactttgcaggcgctgcgggagatcaccagcgcgcctggctattcaggccccataatacgattcgatatggcgggagcctccgccccccgggaaactcgggcactgcacctggcggccgctgactggctggtgcctgcccgggagggggaaccggctcctgcagacagatggcatatgttcggacaggaagataacgccgacgccttcagcctcttcctggacagactgagtgagacggaaaacttcataaaggacgcggggtttaaggcacagatatcgtcctggctggcacaactggctgaagatgaggcgttgagagcaaacacctttgctatggcaacagaggcaacctcaagctgcgaggaccgggtcacattttttttgcaccagatgaagaacgtacagctggtacataatgcagaaaaagggcaatacgataacgatctcgcggcgctggttgccacggggcgtgagatgttccgtctgggaaaactggaacagattgcccgggaaaaggtcagaacgctggctctcgttgatgaaattgaggtctggctggcgtatcagaataagctgaagaaatcactcgggctgaccagcgtgacgtcagaaatgcgtttctttgacgtatccggcgtgacggttacagaccttcaggacgcggagcttcaggtgaaagccgctgaaaaaagcgagttcagggagtggatactgcagtgggggccgttacacagagtgctggagcgcaaagcgccgaaacgcgttaacgcgcttcgtgaaaagcaaatatcggattatgaggaaacgtaccggatgctgtctgacacagagctgagaccgtctgggctggtcggtaataccgatgcagagcgcactatcggagcaagagcgatggagagcgcgaaaaagacatttttggatggcctgcgacctcttgtggaggagatgctggggagctatctgaacgttcagtggcgtcgtaactgatgcaccaggtgaatgaggtgcggtgcgacaaagatattcccggacgaacaacatcagacagtacggatgatgtacaggtgaaataggggagacttcttcagtcagggcgcggcgcaactttttcgatgataacgcgccgcgcgccggtagcgagaagccgatggaagtactggatcacctgaatgcaaagaagggcaggggaaagctgtactttgccggggagggtatccagcaacagtgggctatgaagagaaacatactgtcatcccgatataccacccgctatgaagacctgcttcaggttaagtgacaggtttactctgattttcaaatttctgatgtgatggtgtgccgcagccacattgtatgcaagaacgggctgcggcaaactggcgatcgttcgatagtgcgtgtattgaatagttaccagtcgtggcggattctactggttaaggatgactaatcaatgtatttaagtcatctgttcaacttttcgcgttggagggagcttgaagtcaatttgcagtgaccttcgatagctatttcaccatcatttcaccatttgcaaattggatatataaaaaaaccagccctggcaggctggcttttaaggggaattttggtcggcacgagaggatttgaacctccgacccccgacaccccatgacggtgcgctaccaggctgcgctacgtgccgacttgtgggtgctaatactacctctttccaatgcgaatgcaaggggaaacggtgctaactgatttataattaatcagttagcgataaaacgtttctcttctgttagcacttgcagcagcagactgagctgcggcttctgatctttgatcttctcgccgtgtaagtcataggtctgataatgaccgttattattgagcaccagggtcatttgcggcgtcgtgattgccagcgtactgccgtctgccgccgttacccagttatgacgacgtggaacggtaaagatgtcctggccctgtgaatattcgttcgctggcgtgctgacatgtaacaggcgttgcatcaacgtggtcatcacatcggtatgatcggtaagcacattaatacgctgcgcaggcgtccccggccagtggatcaccagcggtacttgcagatgaccttgcgaccagtcgaagcgattttcttccggcgtcaacggtatgccgcgtcctgcggtaatgatcacgacagtattgtcgaatttaccggcctctcgcagcgcgttcagaacccgattgatttgcgcatccacgtcgctggcggcactggcgtaacgcttaacaaaatttttctggttactgtcatcaatgttagtaccgttaaacgatatccatgagaaccagcggttatcttcctgtgcgtagcgcccaagccagtctatccactggctggccgtttgcgcatcagactgcgtttgcgctgccggcatcgagaaatcggacagtaatgcctgacgataaagcgggctggcgaagccatccgaagaaaacagtcccagttggtagccttgctgattcaacgcggtaatgagcgccgcaggcgttctggtggataacacgccatccatatagcctggcgatatgccatagaacaggccgaaaataccgttatcagtggtattccctgaactcatatgacgggtgaagtcgatgttttgctcggcaaatgtagccagctccggcatctgcttctcaaagcgagaatagttcaggccgtctacggtaatgagcagcacattctgaccggtgcccatatcgcgatagtgcaaattgctgagcgggtactgaacggagaccgcttccggattgccttgctctaccagacggcgctgatattcctgcgcatccagcagaccgtgtttttcaagaaaacgtcgcgccgtcatcggataagagagcggcaggtttgcccgctgcatggtaatcggccggtaaaaattagcgtctgcccagatgtagataagatgcgatgcgataaaggagacgaaaaagaatgccgcaagcggccttgcgaaatggcggcggcgcgtgagactgcgcagcttttgccaactccatgtcgcaaatagcatctcaatcaataagataactggcacgctaataaacataagctgccagtcgcgcgccatttcgttctggtcagggttgatgaccagttcccagacaatggggttaagatgcaggtgaaaacgggtaaagacttcgctgtcgataagcaacaacgtcatacccgcggtcgccagaatggctgataaaaaccgcatcagccgctgggacatcacgataaacgtgagcggaaaaagaataagcaaataggtggcgaacaccagaaagctaaagtgcccgacaatgctcaggtaggagtatatgcgacccgcaagcgttgtcggccagtcggcgacaaacaggtaacggctgccgagcaacgtagccaacagtatattgaacagagcgaaccagtgcccccagctaaccatctgggagactttttcacggtagcgctgacgatgagttaccatacctgtcgcttgtttctccggagtcggctttttagtgcgcgttgtcttcgctaatcgaagactgcaaggcgcgggcaaaagagttcgcaatcgcctggcgttgagccggcgccacgctggtgttgataaggttggtgaccatatttcccagtaccatcagggaaagatcggtcggcgccttatgtttttccagtacactgagcagttcgctcagcagttgttcaacatgttcatcactatagcgggagagttgtggcataaatcaaaatctgtttgttcatgaaagggcaacatattaccgtagcaacagttttttttctgcatttttatcccctaaatcattcgcgttacggataacgcctgaaatgacagggcgattgcttgcgtcttccggcaggcggtggttgaataccgcccggtcttaaaggagagtttatcatgagtctggatatcaaccagattgccctgcaccagcttatcaagcgcgatgagcaaaatcttgagctggtcttgcgcgattcattgctggagccgacaaccaccgttgtcgagatggtggctgaactgcatcgggtctatagcgccaagaataaggcgtatggcctgtttaatgaagagagtgaactggcgcaagcgctgcggttgcaacgtcagggggaagaagattttcttgcctttagccgggcggcgaccggacgcctgcgtgacgaactggcgaaatatccctttgcggacggcggcattgtattgttctgccattatcgttacctggcggtggagtatctgctggttacggtactgaacaacctgagcagtatgcgggtcaatgaaaatctggacattaacccgacgcattatcttgatatcaaccatgcggatatcgtggcgcgtatcgatcttaccgagtgggaaactaatccgcaatcgacccgctacctgacgttcctgaaaggtcgggtagggcgcaaggtcgctgacttctttatggatttcctcggcgccagcgaagggttgaacgccaaagcgcagaatcgcggcctgttgcaggcagtggatgatttcaccgcagaagcgcagttggataaagcagaacgtcagaacgtgcgtcagcaggtgtacagctactgcaacgagcagttacaagccggggaagagattgagctggaatcgctgtctaaagagctttccggcgtcagtgaagtcagcttcagcgaatttaccgccgaaaaaggctatgagctggaagagagcttcccggcagatcgcagtacgctacgccagttaaccaaatatgccggcagcggcggcgggttaacgattaactttgatgcgatgctactgggcgagcggattttctgggacccggcgaccgataccctgactatcaaagggacgccgccgaatttgcgcgatcagttgcagcgacgcacgtcgggcgggaaataaaggcatacgacataaaaggacgccgtagtgagtaaaggaatacgtcagaggccgcctgttaatttcagtttatttcggcaggttttgtatgcgcacattgtcgcatttttgatgatgttgatgctcggcatggtgttcaccgttctctcgttggtactgttttatacttatggcgccaactggttactgagcttgttcatatgcccgctgttcttgttaagtggtttattcattactggatttgcttttaaatcaacctggtccagcatacgttactattacgacaaggggcagttgaaacggtatggactcaatcttgatgcaactttgacgcataaagagaaggtggaaatacgcatcgataatgcaaagcgtcaagtgcgtgtagatgaactggaactccatgtcttatttgattttcagtttgatagcaagacatggagctgcggcgacttactgaccaatgaaaaggtatttgatgcgttgaatgatgggcaaacgataccaatacgaattttgccatggaaaccggaaagtgccagcgttcgtcaacgggcattattcaatcggcttaaaggtatgaataccgcggcggaaactacagatcctcgattaggggaggcgctaattgaatgtggcgaggtgtaagaaagcagaaaagcaaagtgggttctcgttgctctgcatgtcgtcaaattcaattaaacgcataaaaaaaccccgccggggcggggtttttcttcaacttccaggcgattacgcgcgaacgaagtcgatgtgagtcagcttcggtttgtaagcgtgacgctgtacagcctgagctttaacttttacttctttaccgtcaacaacgagggtcagaacttcgctgtagaattcagctttagcttgcatgttcatcacctggtcgtggtccagttcgatagcaatcggggcttcagaaccgccgtagatgattgccgggaacttgttagcggcgcgcaggcggcggctcgcacccttaccctgctctttacgtacttctgcgttgatagtaaacatttaaatctctctttaataattcctgctacaggcgacccagcaacaggtaagtgatctgctttgcgtatgcaaaggcgggcgggattctatactcaaatcgccgttacatcaatgaaaagtacaattaaccacgtaattcgtgcgcccggcggaagcggccttcatagtcgaacactttttcacgcacctgccagtactggcctttcatccgcgcgaccacaaaatcgggatgccgcaacagcgcctgctgcgcgacaatatccgccgccgtgatccagcgtaaaggaacgccgggcgtgcgcgtatgcgggcgaataaatagctgttcgaaagcggtacgctgggcgggcgtgtgcaagcggaagcgctcactgacatccgcgccgtcctcgtcatagtaagtgattttcagccattcgcctttctcatcctgcccatgctgcatcgtcattccgctacagcgcaggactaacgcatccttgagcctgagcgccgcttttaacatatcgtccgggtcgaccagaatggcgtcacattcccggcagcgtcgggcggcaatatcgttttcggcattacactgcgggcagtttttgaagcgaaagcgaaaatcgcactgctcgcgatggccgtcgtcatcctcaaaccagccctggcagcgacggccaaagtgttcaatcagcgtgccgtcggcagtggttttcccccagaaggtgttggcaaagccgcaggccgggcaaaatacctggacagggacgttatcgctttttcccttcgggctaccgacctccggggcatacaggtcgtgcgggttgcctgcgtaatcaagaatcaggcaatcggtctttcccggcgcaaggcgcagaccacgcccgacaatttgttggtaaagactaactgactccgtgggacgtagaatcgcgatgagatcaacgtgtggggcgtcaaagccggtggtcagtaccgagacgttaaccagatagcgaaaacgctgcgccttgaaattatcaatcagcgcgtcgcgctcgggccctggcgtatcgccggtaatcagcgccgcgtcgtccgccggaagcagaccgacaatctctttcgcatgttcgaccgtggcggcgaaaatcatcacgcctttgcgcgtttgcgcaaattccataatctggctgatgatgtgcggcgtaatccgctgctgctttttcagctcgcggttcaggtcggcttcgctgaacagcccattgctttgggcctgcaggcggctgaaatcgtattggaccactggcatatcaagccgctcaggcggcgtcagatagccgtgtttaatcatatagcgcagcggcagttcataaatacagtcgcgaaacagagcgttgtcgttgccgcgcaccataccgtgataatgaaattgataaatccagccttttccgaggcgaaaaggcgtggcggtgagtccaagcagacgtaagtgaggattaactttactcaggtgagtgaggatttgctgatactgactgtcttcatcgtcaccgatgcggtggcattcatcgacaatcaacagcgaaaactcctcctggaaggcgtcaagattacgcgccaccgactgtacgctgccgaacacgactttgccctgactctctttacgtttgagtccggcggcgaaaatatccgcttccagccccagcgcgcaatatttggcgtggttctgcgcgaccagctctttcacatgcgccagcaccagtacccgtccgcgggcgacgcgcgccagttcggcgatcaccaggcttttacctgcgccggtcggcagaacaatcacggcgggcgtacggtggcggcgaaagtggctgagcgtggcgtctacggcttcttgctggtaggggcggagtgtaaaaatcatggtctcactacgttaaacggttccgggaatagtatgccatgaatcatttcccttgagggatatagttagcccgctatactgagcggatagcaattcccttttttcgggtagaatgcccgatttccgtattattacaggctaaatcacacacatgcgacttgataaatttatcgctcagcagcttggcgtcagccgcgctattgccgggcgtgaaattcgtggtaaccgcgttaccgtcgatggcgacatcattaaaaatgcggccttcaaactgctctcggaacatgcggttgcgtatgacggcaatcccttagcgcagcaacacgggccacgctattttatgcttaacaagccgcagggatacgtttgttcaaccgatgatcccgatcatccaacggtgctgtatttcctggatgagccggtggcgtataagctgcatgccgcaggacgtctggatatcgatactaccggtctggtgttaatgacagatgacggtcagtggtcgcaccgcattacgtcgccgcgccatcactgtgaaaaaacctatctggtgaccctggagtcgccggtggccgacgatacggcagcgcaatttgcgaaaggcgtgcagttgcataatgaaaaagatctcactaaacccgctacgctggaggtgataacacctgtgcaggtccgtctgaccatcagcgaaggccgttatcatcaggtgaagcggatgtttgccgcagtaggcaatcgcgttgtggaactgcaccgcgaacggattggcgccattacgctggatgagaatctggctcccggcgagtaccgcccgttgactgaagaagaaatcgccagcgtcggctaactatctcgttaaattcaggagttcgatgtgaccacccggcagcactcttcctttgccattgtctttattcttggcctgttggccatgttaatgccgctgtcgattgatatgtatcttccagcgctgccggtgatttctgcgcaattcggcgtgcctgccggtagcgcgcagatgacgctcagcacctatattctggggtttgcgctgggtcagcttatctatggaccgatggcggatagcctcgggcgtaagccggtcatcctgggcgggacgctggtatttgccgctgcggcggtcgcctgtgcgttggcgcagactatcgatcaactgatcgtgatgcgtttctttcacggtttggtggctgcggcggcaagcgtcgtcatcaatgcgctgatgcgggatatttatccaaaggaagagttttcgcgcatgatgtcatttgtcatgctggtcactacgatagcgccgttaatggcgcccattgttggcggctgggtgttggtatggttaagctggcactatatcttctggatactggctattgcggcgattctggcgtcagtcatgatctttgctttgattaaagagacgctgcccgttgagcggcgtcagccttttcatattcgtaccacaataggtaactttgccgcgttgtttcgccacaaacgcgtactgagctatatgctggcgagcgggttcagttttgccggtatgttctcttttttgagcgcggggccgtttgtctatatcgaaattaatcatgttccgccgcaggatttcggctactacttcgcgttgaacatcgtatttctgtttgtgatgacgattatcaacagccgttttgtcagacgggtaggggcgctaaacatgtttcgggccgggctatggattcagtttgcgatggcggtgtggatggttttcagcgcgctgatgggcattggattctgggcgctggtggttggcgttgcggcgtttgtcggctgtgtgtcgatggtttcgtccaatgcgatggcggtcattttggatgagtttccgcatatggccggaacggcgtcttcgttggcgggcactttccgctttggtattggcgctatcgtcggcgcgttgctgtcgctggctacctttaacagtgcgtggccgatgatctggtcgattgcgctttgcgccgcctgttccattctgttttatctctacgccagccgtcccaaaaaacggtgacgggcgcggtgtccctcaatggcgccgaagaatgcgcaggcggcgttggggggcgctatccgctacacgatggcaaagccaaacggctttcatagttgatgtatatcaattaccaattcatcattttcctcctttatgtttattttatgtaaaatccatttatgtaaaaagtcacatcattgtagttaaaaaggttgagttagatcgcagaaacgggtacatatagcccgccgctatctccgcgtcggtaaaactattttaactcccgcttgctgtagagccactgacggagagaagggcgttagcaatctgtttaaggacgggttgtcaatgatgtgttaatataaatgtaagtaaattgtgaagtaattgtgcttccggggaaagaaagtgaatacattacagctctcaattgttcaccgtctgccgcaaaactatcgctggtcggcgggttttgcggggtcaaaggttgaaccgattccgcaaaacgggcagagcaccgagaatagtctggtggcgcttaaactgttgagtccggcaggcgatagcgcgtggtcagtgatgcataagctcagccaggcgctaagcgatattgaagttccttgctccgtgctggagtgcgaaggggaaccgtgcctgttcgttaatcgtcaggatgagtttgccgccacctgtcggctgaaaaatttcggcgtggcgatagcggaacctttttctaacaataatcctttttaggcgtcagcttaacgcgagtagctgacgcgtatacgcttgttgcggtgcggtaaacacgcgctcgcattgcccctgttcaaccacctccccctgtcgcagcacgataacctgatggcacagcgcgcgtactacatgcagatcgtggctaatgaagatataggccagacggtgcttttgctggagcgatttcaggagggcaagaatctgcgcctgaacggttttatccagcgatgaggtcggttcatccagaataataagcgacggttttaaaatcagcgccctggcgacggcgatacgttgacgctggccgccggaaaactcagcggggtaacgatgccgcgtttccgggtccaggccgacttccatcatgaccgctttcacctgctgttcgcgctgcgcgcctgaaagcgtaggctggtggacgcgcaggccttcttcgataatttgcaatacgtttaaacgcgggtttagcgatgagttcgggtcctggaatacgacctggatacggtggcgaacaggtaaaagctggcggcggtttaacgtatccagcgattgaccgtcaaacacgatgcggccttcggagcggataagccgtaacagcgccagaccggtggtgctttttcccgatcctgactcgccgaccagacccagcgtttcgcctggatgcagggtgaaactgatattgttaaccaccacattatgatccacgacgcgcttcagaatgcctttgcggattgggaaggcgacgcgcagcttgtccacttccagcaacggcgcctgcccggcggggagcggaaccggatcgccagtgggttcgctgttgagtagtttttgcgtgtacggatgggtcggcgcggagagcagcgtgtcggcgcgttggttctctacgcacttgccgtgttgcattaccgccactgaatccgccagtttttttacaatgctgaggttatgggtgataaacagcaatcccatattgagctcacgctggagttcccgcagtagagataagatctgcgcctgtacggagacgtcgagggcggtggtcggctcatcggcgatcagtaattccggccgtgttaacagcgccatggctatcatgacgcgctggcgttcgccgccggaaagctgatgcggataatcgcgcagacgctggctcgcctggcggataccgacccgatccagacaaccgatcatctccgcccttgccgcctcccgacgcattccccgatggagcgacagcacttcatagagctgtttttccagcgtatgcagtgggttaagtgaaaccatcggttcctgaaaaatcatggcgattttattgccgcgtacgccgcgtagcgtctgctcgctggcatgaagcaatgattcgccgtgaaagcgaatatcgccggagaggtagacggcgggaggggtaggcaaaagacgcagaatggaaagcgccgtcacgctttttcctgatcctgactcgccgaccagcgccagcgtttccccggcgttcacctgtaacgaaatggcgttaacgacagggcgcacgtgctgttgctgacggaaacctaccgataaattttcaatcgcaagcaatggagatgtcatcttataccgccttagcaggatcaaaggcgtcgcgtaccgcttcgccgataaaaatcagcagcgatagcagaatggcgacagacagaaaggcggcgatccccagccagggagcctgtaagttgtttttcccctgtaaaagaagttcgccgagagaaggggagccaagcggcagaccgaatcccagaaaatccagcgacgtcagggtggtgatggaactacataaaatgaacggtaaaaatgtcagggtagcgaccatcgcattaggcaacatatggcgcaggataatgtcacgatcgctgacgccaagcgcctgcgcggcgcggatatagtcaaaattgcgggtccgtaaaaactcggcgcgcaccacgcccaccagactcatccagccaaacagcacggttatggccagcagccaccagaagttaggctgcactacgctggaaagtaaaataatcagaaacagggtcggcatccccgaccagacttcgatgagacgttgcccccataaatcgactttgccgccataatagccctgtagcgcgcccgccagtacacccatgacgctggagcaaatcgttaacatcaggccaaataaaatagaaatgcgggtgccgtacaggatgcgggcgaaaacgtcgccgccattcgcatcggtgcccagccagtttttcgccgaaggcggggaggggaaaggctgcgtggtggcaaaattaatggtattggcgccaaagcgtacgggggcccacaacacccagccccgattctcaagctgccgttgtagccaggggtcctgatagtctgccgttgtcgccagcgggccgccgaaatcgcgctcgctgtaattttttaccagcggaaaataccactggccttcatagcgcaccagcaatggcttatcgttagcaatcagttccgcgcataagctcaggctgaacactaccaggaaaatccatagtgaccagtagccccggcgattatggcggaaacgcgcccagcgggcctgattgaccgggcttaatcgcggcattatcgtccctcaaaatcaatgcgtggatcgaccagcgtatagctgatatcgctcaggatattcagtaataagccaatcagggtaaagatataaagcgtgccgaacatcaccggatagtcgcgcgaaacggttgcttcataacccagcagccccaggccgttgagcgagaacatgacttcaattagcaacgagccggtgaaaaacatactgataaaagtggcgggaaacccggcgatcaccagcagcatggcgttacgaaaaacatgtttccagagaatgtttttttcactcacgcctttagcgcgagcggtaacgacatactgtttacgcacctcgtcgagaaacgaatttttcgtcagcatcgtcagggcggcaaaaccgccgatgacggtcgccaacaccggcagcgtaatatgccacaaataatcggtgattttctggtaccacggtaacgtgtcaaagttggcggagaccaggccacgtagcggaaagatatcgtagtagctgccgccggcaaaaaagacgattaataaaatagcgaacagaaaggcggggatcgcataaccaataatgataaacgcgctgctccacacatcaaagcgactgccgttatggacggctttgcgaatccccagcgggatagacaccagataaataatcagcgtgctccataatcccagggtaatggagacgggaaggctatctttgatcagcgttagtacggatgcgctgcgaaacagactgtcgccgaagtcaaaagagagatagtcccgtagcatcttgaaataacgctcatgcagcggtttgtcgaagccgtagcgatgggtgatctccgtgatcacctccggatcgagtccccggccgccgcgataatggctgtcgctgatattgccgacgccggtttgcgcatgactggcgcgaacgccttcgccgctggcgccgggcaacgcgccgccctgaccaaattcaatcgcggcaatagcctgatcgacagggccgccgggagcgatctgcacgataaaaaagttaatggtaataatggcccatagcgtggggatcaccagtaacagacggcggataagataggcacccattgattcttactacctcctggctgccggtagcttggcggctttgttgacatcataccaccaggtatctaacccgatggtatataccgggcgaatcgccggatgggagaatttatcccaccaggcgagcctgtcttgcgccatataccacatcggcagcatgtaatagttccaggtcagcacgcgatccagcgcccgtcccagcggcaccagtttcgctttatcaccctgcgctgcgataatttgcgcgatcagcttatccaccaccgggctttgtacgccgggagcgttataactggagtcaatgtattccgacgcccatgagatttgtagatcggagctgggccagggcatcgcccgccatagcctcggcatcatgtcatagtcgcggctacgcatccggttggtgagttgagaattatcaacctgacggatagtcatcgtaatgcccagacgctgaagattatgctggaagggcagaacccactggctattactgctggcaggaaggagaagttcaaacgtcagaggcttaccggtgacgctattgacccgttgctgtccgttgatcacccatccggcctgcgtcaacaaggcgtcagctttaagaagattttcgcgatcgtagccgtcgccgttagagaccggcggctgatagatctgagtgaagacttcaggaggaagatcttttttcatcggcgcgagtaataccagttcgtcggcgtcaggataatttctggcggcgtactcggtattctggaagtaactgttggttcggctccaggcattatagaacagcgctttattcatccactcaaaatcgaaggccagggtgacggcttcacgtacccgccggtctttaaataccgggcgctgaatattaaaggccagccagcgtgtgtcctgcgccgactcgtttttctgctcttctttaatgatgtaatgattatcgaaatttttaccgatatagcgcgttgcccagtttttagcgtcgttttccagccgtagatcaaatgcgcccgctttaaacgcctcgaaagcgacattgtcatcaaggtagtaatcgtagcggacagtgtcgaggttaaaacgtccacgattgaccggcagattagccgcccagtagtttttgacgcgtgaatagacaatgtactggcccattttccactgagtaatccggtatggcccgctggctaagggcggcgttgaaagtggatcgctgagtttgtgatttttccagaatttttcgggcatgatcggtagtgaaaacagactaagcatgtcttctttaccaggcttcgccagctcaattcgcacggttaaaggcgcaatcgccttcacggtagtacctttatagaccagacggaactgcggtacgccttcggtcataaacttatgaaaggtaaaggctacatcgcgggcggtaatgggcgtgccatcgtgaaaacgagcgcgggggttaatcgagatttccacccaggaatagtcggcggcatagcgggcatggtcggcaatcagcgggtaatagcttccgggttcatcatccgaggtggtaaaaagcgtatcgtaaagggcttcggtacgtacgccgggattgccgcgcagcgaatagcgattgaaattatcgaacgtaccaatggcggaaagcgtcatctgaccgcctttcggcgcagcaggattcacataatcaaagtgatcaaagttaaaagcatacttaggttcgccgagtacggcgaaagcgtagctttctttgatttcctgggcctgggcgccagcgctaaccagtgcgacaagcagaagcattacgcgcgcaatcatctgaaggcggtttccttatcgtattgcccgctgcaaaccggcaggcgtttcgctgaataataagtgacgttgcgtctgatgtgaatccgttaaaaccgtaaggggactaccattcaggcacggaaggcgccgacatccacagcacgaaatcttttaggggtaaaggacggctaatccagtacccctgcaagtaattaacaccgtgatcgcgtagccaacgggcctgctccggcgtttcaacgtcctcggccaccgtcagcatattcaggcgtctggagagcgtcagcacggtatccagaaccggagacgtgacggtttccgtgccgatcgcctggataaagccgcgatcaattttcagataatctaaagtaaatcgctccagataaatcagggcgctatggcctgtaccgaaatcatctatagcgatttcaaacccggcggaatgcagccattcgaacagtttggccgcttcatactgctgaagcatattgcgttcagtgatttccagcacgatatgaaaatggtgcgcgggcagggcgtccctgagccggtgcatatcctctttaaaactgtcgctgtgcagatgttccggcgcgatgttaatgccaaatttggcaccgacgggcatcaccttctgtagcgtgggtgcgtcgcgggcgatcagctcgaacagatgctgcgttaacggtacgataagttgctgcgcttcggcatagtggataaaggcatccggcggaatctcgcctgccgtagggtgacgccagcgcagtaagacttcaagcccggtgacgcttagcgtacgagtatcgacgacgggctgataaaccacataaaactgctcgtgtttgatcgccgttaaaatctctttgcccggtcgcgtccggagggcatagataaagtaacagataaaccccgctacgatgccgctaatgcagcccagcatcaacgcataccacaagtcattgtaggtccagctatcggcataaagctgtattttaagcggcaggccgttgatagttgcctgtcgtgaaggcgtgcccggcagctccgcgacggtcagcagacgcgaagaaaaggtcgacagcgcggtattgccgacaatcagcgcgatgccgttaaaatcgtcctggcgcgtggtatagagtaagtagggcgtcaggttaatattcagcgatgtgaatacgccgctgttatttaataatgggtttcgataccaaatcaccattgtcggtttgttgggcatcattggcgtgccgggcagaatcgccatagcaacgtctttgcggatatctatatccggtaccagttgctgaagcggcatattcatggcgccagtggcggaagagcagaacacttttttatctttaatcaataagaaggcgcggacattaaggctaaaagcggctcttgaggtgagttctgcgccaacctgctgacaggtgttgatcgtcaacggctgaagaatatcggtggtggctttcaggtcggcgaaatagctggctaggtaatgttgtacatcagaaaggagcgtattgtatttaacatcccgtttatgccacgacaggaaaaattgcaggctaccaataagtaatgctgccgctatccccgtaatgatacaggtaagcaggattttccgaccggaagaggagtcgcgtgtaagcataattcctggtgtgacctgaaaaggcagatgccggttaaactggttgatttataagactatagcctggattaccccggatagtcatgcttttctgtgatgcgcaggaaagcgtattgtcgcagtagtcgttggcggaaacgacctgaatgtctgatggcgctatgtttatcaggcctatgttcgtgtgttgtaggctggataagaggcgacacgtcgctattcggtaaaacgggttcagaagggataataagcaaaagcactgctgaagcagtgctttttatgtcgtctcatcaggtaagccaagggaggtgctgcctgatgaagattaactgcggctcagaactcgacgcgcttcattgtagcgttttttccagtacggttcgttcatactggagataatgacgccgctactggtagacgcatggacaaattggttattgccgatataaataccgacatgacggccagtggaaccggcgcggaacagaaccagatcgcccgtacgcaggttattgcgtgaaaccgctttgcccatttcctgctgttcataggttgaacgcggaagctctaaaccaaactgttcgcggaaggtgcgctgtacaaagctggaacagtcgacgcctttcttagtgctgccgcccaggcggtaacgcacacctttccagtcagcatactgatccataatccgcgacttaacgtcgaggttacgcaccatattttcaaattcatcctgagaggcttgcagtgaagagctatcgctattgcccacagcatgcgtctcagaatgcatattctttgcggtattggtggttgtgctacaagcagaaagcagaaccgcaactgcaatcgcaggaatcccgcgcaaaatatatctcaaaatcggttgagatttgaccatgttgtttgttttcccttgaagtccttaacgataaatatcgttataaaaatgccaaacgtgatgagactaattacctgcacagcttgagacaattctttgtgcacaaatctgtggcggaacgcacaaatttattcgcaatgagaataattatctggcgaggcaaaacgagtttgagattacccgattgttgctgtcattgcgagcgatttcgcgtgattttttataagaatttatgatacgaaaagtgagctatcagcacgggtcaaattaagcgcaaatcgtttaaaaatcgtgcaacctgttcattttgcagaggaataatattaccgaaaaatgatgggctgggggaatatcatcataaattaccttcaacgatgtaaaactatcgctgaaggcaatgttaattgtatgggttatttgtttaaaatttgtttatttccgcctgggagataatcctcaaaaagcgctatcgcccggtcgctgagcggggtcatcagccaccaggggaggccaatcaaaataaccgtgagcgacccaaccacaatatcggtgaaccagtgagcgccaatcataacgcgcggaaacgcgaaaaccacaaatataataagggcgataatccccgccgttttgccgaaataacgcagcataaaggcggaaaatatcagcagcatcataccgtgatcgcctgggaaactgtcttttgacgcgtcttttgtcgggatgtgcagcaactcgctgacgcgataaatatgctcaaaagagagcgttggactggcgcgcttgacggggatcagcgcctgaccgagttggttaagcaccaccgctgttagcagcatgaccaatccgattatcacaatgcgccgccggcccgacgcgtcttcttttagccagaaactgagcatcagtccgcccatcgccagcagcgaacagccgtcaaacgcccgattattggtaatagcgacccaccagaggaacgcgtggctttccaccagtttctggttaaagaagtggaatatgccggaatcaatggtgaaccagaaaccgtgattgacgggaagataccatgacaaaaacagcgccagaccggcggcattaagcagaattatcaaggaatagcgggttttcatcgtcatttcgccatagtttttaaacggtggcaaccttacgcgtgcgtcgctaaacgaagcttcaacaaggccgtctgtaacgtattccagtcggtttctgtgtttgagataagttcaacccggctatccggcggcgcgacactctgtgtttcgatgtgcaggtcatcgccctggcgattgatgcgtaccagcccctcttgtatgcgcataacgcctttcacccggcccaccggcgccagacgagcccattcgagtaggccaatggtgtcaaacacggtatcggcatcgaaaatccagccgcaggcctgatgaccctgtccgctattgaggctgcgtcgccagcgctgctgtgcgggcagatttagcgcggcgagtccttttttactggcatgagtgtgagaatgcgcggcgctggccggcagttccgccagattttgtcgcggtaaatccagaagcttaccgtctatctgtccatgttcggcatgaatcagttgacgatcgccgccgtactgtcgccaccactgttgcagggcggcatcgctctgcgccgtggcgcggtcggttttattggcgatgataatatcggctgaggcgagctgatcgcggaaattttcattggcgacgctctgttggtccagtagcaggcgagggtccaggatgcagagcgtggcgcgtaaatcaatccacggctcataaaccggcgcagttaataaatccagaatctgttttgggtgccccagtccggttggttcaatcagcaaccggtcaggtttgccctggcgcagcagcgtgttgagccccacctgcataggcaatccgttgacgcagcacatgcagccgccgggaatctcttttagcagtgcgccgctgtcggcaagcagcgcgccgtcaatacccacttcaccaaattcattaaccaggacggcccacttttcagccggatctttatgagctaataaatgaaggatagaggtggtttttccgctaccgagaaatccagtaataagattggttttggtcacgtcagctccagaatattgatacaacataacaacttttaataatcctggcgaataaacgtgaaaaagagaagtgctgagttgacgaagtcgtgcttctgccatcttaagagcagaaaatgttaaatttttaacgtttctcttgcctggtgcagaacagtcaataaataaaaggggcagactgcgccctggggcgcagccgaaaaatgtgaaacttaatccgcgcgccccatataacggcgctcttcgatatgaatgcggattttctcacctgcgctcaggtattcgggaacctgaatcaccagaccggtgcttaatgtcgcgggtttgttacgtgcgctggcggacgctcctttaatacccggtgcggtttcgacgatttccagatccacggtctgcggaagctctagcgccagcagttggccgtcccaggtcagaacctgcatatccggcattccgccttcaggcataaacagcaactcttcttcaatctgatctttggtgaaggtatacggcgtatagtcttctttatccatgaacacatattcgttgccatcgacataagaaaagtcaacgccgcgacggctcagggtgacggtatcaacgatatcgtcgcctttgaaacgttcttccactttcagaccggtgcggacatcggaaaagcgcattttatacagtgtggcggcgccacgggcggtaggcgactgaatgtcgatatctttcacaatcagcaatttgccgttgtagttcagtaccataccttttttgatttcgttcgctcttggcatcgaggagatcctgttgtagagattatctaaaatatcgcgtaaaactactcgcgccgggccgtccaggcaagtggaattgtcacttttgctggtgcaaaaaaggtgatactgttcgcccgctttccgctccgcgttcaacgagaatacgcgatggcatgtcgcctggaggggggaagtgtgctgtgttgtcccttctgtttccagccttgtcttcggaatgtctgaggacaggcctgatcatgatgacgtccacattttaaatctggatttttctttggacaaattctgttatctttcatttggttataaatagaggggctgagcatggactgtcgtagcggttgtggcgcttgctgtattgcgccttcaatttcgtcgccgatacccggaatgccgaatggcaagccgatgaataccagatgcgtgcagctttcggaagataacttgtgtcttatctttggctcgcctttacgcccaaaagtgtgctttggtttgcaaccgacaggggacatgtgtttaacgacccgggaagaggccattatttatttgctggaactcgaacagaaaaccttaccatgagctaatagcctaatgggataggctctaagtcagctgtttttgataaacgtgcaggggcttacgttatatcccgaaatagtctgcaaaagctgcgcatcaaattacctccttttaccattaaatagcgtaatacatgcttcccttatttcgtgtcttctgaaacggtagatgtcgccgctcaaccccgttggtgcctgaacgtgtaccgaacaaaccgtcacataaaacaaaagcgatcaattttatttatatgatagtttttatctattaaaaagaggaattttgatcgattttaattatttataacgatcgatatcattagtttgatagtttatatctatcattgatgtatttaccgatcgatataaccagtgtgaatgtgttgttattttcctttaaaatactcgaattcttatgtgtgggttttatcttatgaagaaatatacgttcgcagccagggcgtttatttttacgttggtgttgctttttgttatttcagtattcgggttgactattagcgttttaaaagggatgtgaaatgcggggagaaaatagtgaaattgatttagtcgacgtttccttattccttataagaaaatggctaagtatcgtgatcgctacctttatttttgtcgccattggctatgtttttgtgagcgtgcatcatgatacaaaggttgtgagtattacaatcaaacctaatctggatacgcctgctacctatgcgttatgtggctatgctaatgatattcaatgtaaaacaacggttatccttaaccagtttagccgtttcttgcctgcggaatataaaaataaaataagttttgacgcgaaaaatcagcttgtcctttttaaggcgcaggggagggaagaaagcgtcaataatattatttccaccctgaaaaatagcgtcgataaaatggcagcatggtatatcgatgatggtgacattaaacgttatagcgtgcataaaaatatgttacaaacggaaacatatacaaagctatccttgttgtcggaggcggttaaaaataatgctaacattgaagtgatagatgttgctgttacaccaaaatataagatgcggctggtgttggtcctttgcgggctgatgggcgtaattttctcaataaccggtctcttatgtaagagggcgctaacagaatatcgtattgagaaaaagacaatgaatgaccgcgcatgaacatcgcgcagaaataaattctgcgctgaaatgtgtcgaagagtaaaagtatcaggcttgcaagttaaacatctttaatacgcgccaggcagaacatggtggcgacaatcataactaacgcaaaccagaagaccgcatgataattccagatttctgcggcgattcccgccaacgaaccggcaatgatccagccgacgcgaatggtattggtatacagcgtggtggctgaacccgcctggcctggcatgagatcctgaaaatagagcatgccaatcccgccaagaatgccgatgtaaatcgcgttcagcaactgcaagccgagcaacgttgccggtgcgtgcgccagcaacatccccgcataaaagcacagtccggcgacaacggcgatgcacattaacaggcgttttcccaaccgtttggcgaagtaacctgcaatcagcattgtgggaatctccagcccggcggcggtgcccatcatcacgcctgcaagtttttccggaagatgcagctcattgatgataaacagcggcatattaatgatatacaggctgttagtcccccacattaacgtacagatgacaaacagcaacagcgtatcgcggcgattacgacgcggtgcttccagcgtgccggttgccagcggcgcatctttgcgcattgacggtaaaaagaaccacaccatgacgccgcagacgataaaagctaccgccgcgctcaaatacatcaccgtaaagctaaaacccatcgccagcgcataggccagcggcggcccaatgacccaggccaacgagacctgggcgcggaggattgagctgaacatcaccgcttcacgacctgtacgatcggcatgttctcgggccagcgcaaacatctgcgggttggcggtagagccgaagctactgagaaagacgccgatgaacagcaaaataaagtagttgcggttccaggcaaacaacacgcaggccaacatgcccagcacgcaacagaaaacgatcagttttttgcgatcgccttttttatctgagcgacccgccagaaactggctcacgataatgccgataaccgcgctgccggtaaaaaagaaacccaccatgccgggacgggcgtgaacctcatccgtcagaaaaatactgagtgtcggcgtctgtaacgcaccagcaataccggtgagaaaagcgacgatcaaaaaggcggtagacgtcaggtcaaacgatttgggcgcagcggcggcgggactgttgtgcatgtttctatatcagtggtgtgaagagaggcggagtttacgctgcccgtcagaaaataaacaggcgtctgaatcaaaatcgacacgaaaaatcaaaatagcattccagtttgttacaagggcgtgctgacgcaagctgaaagaaaaaagctgaagccttttatgcgtcagctattgagggtctgttggagaaaaaatgtgcttcacctcaaaaaattgctacaaaaccggtaacttttcttgcgtgctgaagcagaaagatccagactttcttgaaacgtttcagcgcgatctggtttttttgataactcagattggcgctttttttctcatagtggctgaatcgtttcaattcagcaggagaggagacacatgttccagttatcggttcaggacattcatccgggcgagcaggccggaaataaagaagaggccattcggcaaatcgccgctgcgttagcgcaggcggggaatgtggcgggcggctatgttgacggtatgctggcgcgcgaacagcaaacctcaacctttcttggcaatggtattgcgattccccatggtacaacagacacgcgcgatcaggtgctgaaaaccggcgtccaggtctttcaatttccgcagggcgttacctggggagaaggccaggtcgcctacgtggcgattggtattgccgccagttcggacgaacaccttggcctgctgcgtcagctgacgcatgtgctgagcgatgactccgtggctgaacagctgaaatccgcgacaacggcggaagagctgcgcgcattgctgatgggcgagaagcaaagtgaacaattaaaacttgataacgagacgatgacgctggatgtcatcgccagctcgctggtcacattgcaggcgctaaatgcggcgcgtctgaaagaggcgggagcggttgatgcggcgttcgtcgcaaaaacgattaacgatagtccgatgaatctgggacaaggcatctggctgaacgacagcgcggaaggcaatttgcgcagtgctgttgcggtaagccgcgcgacccaggcgtttgacgtagagggtgaaaaagcagccttattagtcactgtcgcgatgaacgacgagcagccgattgccgtgctaaaacgcctcggcgacctgttgctgaacaataaagccgatcgtctgctgagcgctgacgccgcgacgctgctggcgttgctgaccagtgatgatgcgctgacggatgacgtactgagcgcggaatttgtagtgcgtaatgagcatggtctccatgcccgtccgggcaccatgctggtgaatacgattaaacaatttaacagtgaaattaccgtgacaaaccttgatggaaccggcaaaccggcaaacggacgtagtctgatgaaagtggtggcattaggcgtgaagaaaggccatcgtctgcgctttaccgcgcagggtgaagatgctgaacaggcgctgaaagcgattggcgatgcgatcgccgccggtcttggggagggcgcataatgagcaggcgtgtcgccaccattacccttaatccggcttacgatctggttgggttttgccctgaaatcgaacgcggcgaagtgaacctggtgaaaaccacgggtctgcacgcggcgggcaaaggcattaacgttgccaaagtgctgaaagacttaggcatcgacgtcactgtcggcggttttctcggtaaagataaccaggacggttttcagcaattattcagcgaactgggtatcgctaaccgctttcaggtggttcagggccggacccgcatcaacgtgaagctgacggaaaaagatggcgaagtgaccgacttcaacttttccggctttgacgtgactcccgcagactgggaacgctttgttaacgactccctgagctggctgggtcagttcgatatggtctgcgtcagcggtagcttaccggctggcgtgagtccggaagcgttcaccgactggatgacgcgtctgcgcagccagtgtccatgcattatctttgatagtagccgtgaagcgttagtcgccggtcttaaagctgcgccgtggctggtgaaaccgaatcgccgcgaactggaaatttgggcgggtcgtaagctcccggaaatgaaagatgtgattgatgcggcgcacgcgttacgcgaacagggtatcgctcatgtggtgatttcgctgggggcggaaggcgcgctgtgggttaacgcctcaggagaatggatcgctaaaccaccggcggttgacgtggtaagtaccgtcggcgcaggcgattccatggttggcggattgatttacggcctgctgatgcgcgagtccagcgaacatacgctgcgtctggcgacggcggttgccgcgctggcggtcagccagagcaatgtgggtattaccgatcgtcctcagttggccgcaatgatggcgcgtgtcgacttacaaccgtttaactgacagcaggagaggcataatgaaaacgctgctgataattgacgctaatctcggccaggctcgcgcttacatggcgaaaaccctgcttggagcggcggcgcataaagcaaatctggaaattatcgacaatccgaatgatgctgaactggcgatcgtgctgggcgaatctctgccgaacgacaatgctttgaacggcaaaaaggtttggctgggggatattggtcgcgccgtcgcgcatccggaactgtttctgagtgaagccaaaagccatgcgaccccttacagcgcccctgctgcggctgctcctgcagcgagcggcggtccgaaacgcgtggtcgcggtaacggcctgcccgaccggcgtcgcccatacttttatggcggctgaagccattgaaacagaagcgaaaaaacgcggctggtgggtaaaagtcgaaacgcgcggctccgtgggggccggcaatgccatcaccccggaagaggtggcggaagcggatttagtgattgtggcggcggatatcgaagtggatctggcgaagtttgccggtctcccgatgtatcgcacgtcgaccggcctggcgctgaaaaagacggcgcaggagctggataaagccgtagcggaagcgacgccgtatcaaccggcgggtaaggcatcgcaagcggcgaccgaagggaagaaagagagcgctggcgcataccggcatctgttgacgggcgtttcttacatgctgcctatggtggttgccgggggactgtgtattgcgctttccttcgcctttggtattgaagcctttaaggtgccggacacgctggcggcggcgctgatgcagattggcggcggttcggcgtttgcgctgatggtgccggtactggcgggttatatcgctttctccatcgcggatcgccctggccttacgccaggtctgattggcggtatgctggcggttagcaccggttccggttttatcggcgggatcattgccggcttccttgccgggtatatggcgaagcttatcagtaccaaactgaaacttccgcaaagtatggaagcgctgaagccaatcctgatcatcccgttaatttccagtctggtggtggggctggcgatgatttacctgatcggtaaaccggttgccgggattctggaagggctcacccactggctgcaaaccatggggacggcaaacgcggtgctgttgggcgcgattctcggcgggatgatgtgtaccgacatgggcggcccggtgaacaaagcggcgtatgcgtttggcgttggtctgctgagtacgcaaacttacgcgccgatggcggcgatcatggccgcaggtatggtaccgccgttagcgctgggtctggcgacgatggtggcgcgtcgtaagttcgacaaagcgcagcaggaaggcggtaaagcggcgttggtgctggggctgtgctttatcactgaaggcgctattccgtttgcggcgcgcgacccgatgcgtgtactgccgtgctgtatcgttggcggcgcgttgaccggggctatttctatggcggtaggcgcaaaattgatggcgccgcatggcggtctgtttgttctgcttatcccaggcgcaattacgccggtattgggatacctgctggcaattgtggccggtacgctggtggcaggactggcttatgccgtcctgaaacgtccggagacggaagtcgcggcaaaagcggcataagagaaacacgctaaaaaaggcagagcgcgctctgccttttttattgcctgaagaacattgagcgtcaggccatcgcttcggcaatttgctgggcttttaaccacgcaatctcttccgcccagatatcaggattgatggtctccagtatcagcggaataccgtcaaaacgcgcatcctgcataatccaacgaaacgcatcgtggccgatattgccttcacccagactgtgatggcggtcaacgcggctaccgaaggcgcttttggcgtcgttaaggtgcattccgcgcaaatactgaaatccgacaattttcccgaattcggcgaacgttttttcgcacgcctctggcgtacgcagatcgtatccagcggcaaaggcatggcaggtatcgatacagacgccaacgcgcgacttatcttccacgccgtcgatgatggcggctaactgttcaaactcaaaccccagattactgccctgaccggctgtattttcgataaccgccgtaacgccctcggtctgcgcgagggcaatattgatagattccgcgatccgcgccaggcaattctcctgtgcaatctgcatcagatggctaccgggatgaaaattaagcaaggttaagccgagttgttcacagcgctgcatttcatcgagaaaggcatcgcgtgatttttccagcgcttcactgaccggatggcccagattaatcaggtaactatcgtggggaaggatttgcgccgccgagaaatgatacttttcacaggcgattttaaagtcatcaatgacctggggagtaaggggggcggcacgccactgacgctggttttttgtgaaaagcgcaaaggccgttgcgccaatttcagccgcgcgggcaggggcgttagccagaccgccagcagcgctgacgtgcgctccgatgtatttcataaaagactcctgttaaacccgctaacggttcattacgaacgctatgataacgggttaacaggcgtgaaacgtaataatttatgcgataaggctatggattaggacgttaatggcgccaccgccaataatcagccaggcgaataatgccagcgccatcagcagcggtttcgcccccgcttttttcaatgcgctaacgtgagtggtcagacccaacgccgccattgccatcgccagcagtaccgtgtccagcgtcaccagcatatccaccacggctttcggcagcaggtggaaagagttgaagatcgccactacgatgaagaaaatagcaaaccacggaatggtaattttgcttttttccgcgccggtcgccggggaaagctgtttaacgcgtgccgccagaatgatcaggaacggcgccagcatcatgacacgcagcatcttagcgataactgccgcattttccgcatccgggctaacggcgtgacccgctgcgaccacttgcgcgacttcatgcatggttgagccgatatagatgccgtaagtttccgggctgaaccagtgcgccagcagcggatacattgccgggtaaaggaaaatagcgatggtgccgaaaataacgacagtcgcgacggctacagtaaccttactggcttccgcttttaccaccggttctgtcgccagtaccgccgccgcgccgcagatactgctaccggcgccaatcagccagctggtatgcctgtccagaccaaagactttttggcctaagaagcaggccagcatgaacgtgctggaaagcgttaatacgtcaatcacaataccgctaatacccacgtcggcgatttgtgaaaaggtaaggcggaagccgtaaaggataatccctaaacgcagtaaatgttgttttgcaaacagcacgccgccgtcgcattgtttccatatttgtggatagacggtattcccgataaccatacccagcaggatagccagggtcagggcgctgaaccccgcgcctgcaacagcagggatagcgccgccccacagggcgactcctgtaatgacggcgctcagagcgagccccggtataaaatgccacattgtacgacgatgattctgcaaggtgagttctgtcataaccttctcctgtatatggacaataaggttacggtgatctggtttaaaaataaaattgattatatatttataattaatctttataagtggtaagtgaaacgctatcggtgggatacgactatgcatattacgctacgacaacttgaagtgtttgctgaagtactgaaaagcggttcaacaacccaggcgtcggtcatgctgtcattatcgcagtccgccgttagcgccgcgctcaccgatctggaaggtcagctcggcgtacagttgtttgatcgggtggggaaacggctggtggtcaacgaacatgggcgcttgttatacccgcgcgcgctggcattgctggagcaagcggtagaaattgagcagctatttcgtgaagataacggcgcgatacgggtttatgccagtagcaccatcggcaattacattttacccgccatgattgcccgctatcgccagcattatccggccttgccgctggaactcagcgtgggaaacagccaggacgtgattaacgcggtgttggattttcgggttgatatcggcctgattgaagggccgtgtcacagtacagagattatctctgagccgtggctggaagatgagctggtggtctttgccgcgccgtcctcgccgctgacgcaggggccggtgacgctggaacagcttgcggcatccccatggattttacgcgagcgcggttccggtacgcgggaaattgtcgattatttgctgttgtcgcatttgccgcgctttcatatggcgatggagttggggaattcagaagcgatcaaacatgcggtgcgtcatggactggggataagctgtttatcgcgccgggtgattgctgaacaacttcaggcgggaaccctgggcgaagtcgcggtgccgttaccgcgcctggtgcgcacgttgtggcgtgttcatcatcggcagaaacatctttctaacgcgttgcagcgttttttgagttactgtgaataaaggtgaagaggagggctgcccgagcggcatcgccatttttagtatccgcttacgtatacgttattctctgctttacttataatccgtggccggtcatgaaggtctcttataaccgcgcatttgtgtcggaaggatagtatttcgtctgttacaatcgcgcctcattttttggatggatagcattttcacatgggttccaaaactaaaaccacagaagcgcccgcgctacgtcgcgaattaaaggcgcgtcacctgacgatgattgccattggcggctccatcgggacaggtcttttcgttgcatctggtgcgacaatttctctggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgcggttttggcgaggcggagtactggttctcgttaattaaagtcgcgaccgttattatcttcatcatcgttggcgtagcgatgattatcggcatctttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccgcgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtatcgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggcacgcatttcgtgcgctatagcgaaatgcacttcccggaacgcgttaaaaagtaacgtaatattctcgtcataggccggataaggctttatgccgccatccggcacggactgcctgaacctgacccttctaaccctctcattcgagagggttttttgttttttctttatgattggttcaaatgacataattattaacaattaaattgataattattatcgtttactttatcgttacgctcgaaatcagaaaggatgaagattcgggcgcgaccgtcactcatgagcccgactcgcctgcataaaaagagttcgccgtgataaccgttatcgcaggcgaaacgtaatgcgttgtgagcgataaccgatttttttgtcgtatttacctcatggagaaatggaatgtttaggtttaaccctttcgttcgggtagggctttgtatgtccgcagttacgttggcctggccggttgccgcggcaacggatgatggtgaaaccatggtcgttaccgcgtccgccatcgaacaaaatctgaaagatgcgccagcaagtatcagcgtcattacccagcaagatttacagcgcaggcccgtgcaaaacctgaaagatgtcctgaaagaggtgccgggcgtacagctcactaacgaaggggataaccgtaaaggcgtgagtattcgtggtctggacagcagttatacgctgatcctgatcgacggtaagcgcgttaactcccgtaacgcggtcttccgccataatgattttgatctgaactggataccggttgacgctatcgaacgcattgaagtggtgcgtggccccatgtcctcgctgtatggctccgatgcgctgggcggcgtggtcaacattatcaccaaaaaaattggtcagaaatggcacggcagcgtcacggttgactccactattcaggaacatcgcgaccgtggcgatacctataacggtcagttctttaccagcggtccgctgatcgacggcgtgctgggaatgaaagcctacggtagcctggcgaaacgcgaaaaagacgagcagcagagttccgccaccaccgctacgggtgaaacgccgcgcattgaaggatttaccagccgggatggaaacgtcgagtttgcctggacaccaaacgaaaatcatgacgttaccgcaggctacggttttgatcgccaggaccgggactccgactcgctggataaaaaccgactggaacggcaaaactacgcgttgagccataacggacgttgggatctcggcaatagcgagctcaagttctacggcgaaaaggtggaaaacaaaaaccccggcaacagtagccctatcacgtcagaaagcaattcgattgacgggaaatacgttctgccgttagcgtctgtcaaccagttcctcaccttcggcggcgaatggcgtcacgataaactgagtgatgcggtgagcctgaccggcggttccagtactaaaacctccgccagccagtacgctctgttccttgaagatgagtggcgcatcttcgaaccgctggcgctgaccaccggtattcgtatggatgaccatgaaacctatggcgatcactggagcccgcgtgcttatctggtctataacgcaacggataccctgacggtgaaaggtgggtgggccacggcctttaaagcgccgtcgctattgcaattaagtccggactgggcgaccaactcctgccgtggcggatgccgcattgtcggtagcccggatctgaaacctgaaactagtgaaagctgggagctcggcctttattaccggggcgaagaaggcatactggagggcgtggaagcgagcgttaccacgttccgtaacgatgtggacaatcgcatcagcattagccgtacccctgacgttaacgccgcgcccggctattccaactttgtcggcttcgaaaccaacagtcggggacagcgcgttccggtcttccgttattacaacgtgaataaagcacgtattcagggtgtggaaaccgagttgaaagttccgtttaacgaggcgtggaaactgtcgttgaattacacctataacgacggacgcgatgtcagtaatggcgggaacaagccgctttccgatctgccgttccacaccgcgaacggtacgcttgactggaaaccggcgcagcttgaagactggtcattctacgtatcagggaattataccggacgtaagcgggccgacagcgcaacggcgaaaacgccgggcgggtacgtggtctgggataccggcgcggcatggcaggcgacgaaaaacgttaaactgcgtgcgggcgttctgaacgtgggcgataaagatctcaaacgcgacgactacggttataccgaagacggacgtcgttactttatggcggtggattaccgtttctgacagagactggcgacagccgcgttttgccgctgtcgccagaatgttataaccgatgcagcctggagagcagcgccagcgacagagtcgttagcagaatggcgattaacgcatagatataaacgcccgaccacgcccagctatttttcaccataattaccggcacaccggccattgccgcgccgacatagctgaacaatccccgaaagccggtaatcgatcccgccgcatccttatgggtcacatccagacagccgacggcaaaaagcatatgcggtccgtataaggcgaagcccatgatggtgaacagaatcgcgctgagggtgtaagaggtatcctgaaccagcggcaccagcacgatgcatatgcacagcgctaacgcgaagattaacccggtcatccagcggttacttttgaacataaagtcagacaagtagcctgccagcaacccacctgccagtccgcccgcctcaaatcaggaaataatcgagttcgcttttatcagactccagccgtgaacctgcgaatagtaaatctgcggccagtcgttaagaatagtgcgcgcaatataaaccgacatatcaccgataataatgatccataccagtggattggtcaggatatatttcacaaaaatctgccagaagctcaggttgaccgggctggccttgacctgggccagttccgtcgggtcgttacgccactgccccacgttgggcaaacctaacgtaccgggacgatctttaatggtaaatagcgtcactatccccatcagcagcgaaatggcgccgggaacataaaatcccattttccagctaccgctaaaggcgatagcaaaactggtcagcagcggcgcgaggctgccgccgatattgtgcgccgcttcaacgatagcccaccagcgtccccgttcgtttttcgaaaaccacgaggccataattttcgccatcggcggaaagctggtgccctgtaatatcgcgttgagactgtacagcacgtagaatgccgccacgctgtcggaaaagccgaacagaatatttacaatccccacgccaatcagcaccgggccggtcatggctttcgggttaattttatcgaccagcatcccgccgacaaacttcatcgcgccataaagaatgtaaaaaatagaagacataatggcgaagtcttctgcggtcagcgacgtttccgtcagcatggccggcatcgcggcggagaagtttttacgggtaagataaaagacggcataagagataaagaccgaggcgataatctcaaaacgaaattttttataggtctggtctatctcttttttctcttttacaatcggcttatcgggctggctgaaaataaatgtttttatactcattttaaaattcccttccggcgaggtgagtcgcgttataattcatcttcaataagaaaaagaagcaattcgaaaccgtgataattaatctgatggtggattttttcccgtacaaccggcttcgctttccaggcaataccggtgccagcatgttctaacatcggcagatcgttggcgccatcaccgcaggcaataatattctccgtggcaatatttaaccgggcagccaggtcaaccagcgtctgttttttgtttgcggcgttcataatcggcaaggtaatgttatccgtcagaacgttatcgcgtatttcaaccgtattcgaaaaggcataatccagttgataccgcgcttttagacgctgggtgaatatatccagtcccccggagataatcgcggttttaaatcctttggccttgatgactggcagaatagttaacaggcctggcgaaagggtcatgcgatcgcatacggcgttcagcactgctttcggtgtgcctttcaacattccgatacgtcgggtaaaactggcgttaaaatcaagcttgccctccatcgcctgttgggtaatggcggtgatttgcgtcgacatgccaagctcgcgggcaatttcatccacgccttcttccgcaataaatgtcgagtccatatcaaacgcgataataccgttagcaggcagtggctgcggcttaataaaaaaatcaaactgccattgcaatgagagttcgcgtaaatagcgataaaattcaggcgtcagacattccgctggcagcgtaagctttaaataagcggtattgataagcgcggcataacgtttatcaaataatagcggaaacggcatggtgacggcattaaataacgtttcctgtaattttttctgaaacgtatcgatatcctgtgtagtaataaaataaataatgctcatatgataactcccttaatttacgggtattataatggctcttttgcggcgtggaatctcgtgctatcacagatatcacagccagaaaagggctaaaaaagcgttgtttttgataccaggtaaagttcagacacaaaaggtatcacttttgatatgccaactgtgcgaggatgttatttattactgaacgcgaatgagactgaaaggattgatataacgatggagagttgccttgatatattcaaaatagtaataggtccatccagctcacgtaccgtagggccgatgcgcgccgcctgtcactttatttcattgctcagagaacaagagacgttgccgctaattcgggaaattgaaatcgagctgtatggcgcgttatcgttaagccgcaagtgccacaatgtggataccgccctgtatcttgggctgctgggttgccagccggagaatgtcgatctccgttcgcatatggcggtgattaagcgtgcggaaaatgaaaacaaaatcgaactcccgctctctgacgcgggcggaatcacgataaaagtcaagattatcgccaatcaccaggcgcatccaggccatccttatgccatgacgttttgcgccagggatgattattttacggtgtatgaagagacctggttttctaccggcgccgggcaggttcgtaaacatggcgagccgctgacgccatcgcttcctttgcgtacagtgtcgccctttgaatttagtcatgccgcgcagttgctggcgctgtgtcggcgtaacggcctgtccgtggcggcgctgatgatgaaaaatgagctgtgccgccactcgccacagacgttgcagaattatctggcgcaaatatgggacgtgatgcagcaggcggtttatcgcggcctgcatactgagggggtattacccggtccctatcaggtaccgcggcgcgcctgtgcgttacataagacgttacaggctaaccgctccgccagcgattttttaaccgcgctgaactgggtcaatgccttcgcgattgcggtaagcgaagaaaatgccagcggcggacagattgttaccgcgccaaccaacggcgcgtgcggcatcattccggcagcgctctgctggtatgataaatttgtcacgccgctggagcccggtgctctgacccgtttcttcctgaccgccgccgctatcgcgatgctgtttaaacaaaacgcctctattctgggatctgaagttggctgtcagggggaaatcggcgtggcgtgctcaatggcggcggcgggcctggctgaactgatgggtgcatccgtggagcaaacgctgagcgccgctgaaattgccatggaacatcatctgggattgacctgcgatccgctgggcgggcaggtacaaattccctgcatagagagaaatgccatctctgccgtgaaagcgataaacgcggcgacgatggcgatgagtcgcgtaagcgaaccctgtatttcgctcgatgagatcattgctgcgatgtacgagaccggtaaagacatgagcgctaaataccgtgaaacgtatcatggttcgctggggaaaattcagccgcgcaagagagggtaacagcgtgaaatacaatacgatgaataacgatgagattatcctgtcgttgtgcgcccgcttaaaggagacgcgtctgtctcttgcgatgacccagcagcagcttgccgatcgcgcgcacgttggcattgccaccatcaagcgtatcgagaaggggggagggctcaatcttgatacgctaatttctctcctgcgggcgctggataagttgcataatcttgatgcggtgctgtttgaatccgaactgcgtaattttcacgaaagttatgaaggcggagagggcagcggccgccttcaggtacgccagcaggccgcggatttaaataataaatcttccgcgccgcagtcggaggaggtgaactacagcgcggcgctggaaaattcattatgttggtgacgtctcatgctcgtcccgtaaataccgggcatgaaagcgcagatggtcctcaatgaaggacgcaataaaataatagctatgatcgtaaccgggctggattcgtagcgtcatcggccaggcggtttgccgcgcggcttccgccagtacggcgggctgaagctgatcggcgaggaattgatcgctgtcaccctgatcgatgagcacaggaatggcgtcctgcggctggctggccagcattaattcgcagctatcccactcagtccaggctgattcatcttcgccgagataagcggtaagcgctttgattccccacggcacgcggctggggttgacgatgggcgcaaaagcagagatgctggtgtatttgcccggatttttcagcgccatgattaacgcgccgtggccgcccatcgagtgcccgctgatggcgcaacggtcgctgacgttaaactgtgtctggataagcgccggaagctcatcgcgcaggtaatcgtacatgcgataatggctggcccagggcggctgtgtggcattgagataaaacccggcgccgtggcctaaatcgtatccgctatcgtcggcgacctgttcaccgcgtggactggtatccggcatcaccaatacaatgcccagttctgctgcgatacgctgcgcgcctgctttggtggtaaaattctcatcattgcaggtcaacccggacaaccagtacagtaccggaggcggttcattatcctgagtcggcggaagaaaaatgctgaatgtcatggcgcagtttagcgtggcggcatgatgacgccagcgctgctgccagccgccaaaacatcggtgctcttcgagcatttccatgcgggggctccttttatagtgaacctgataaggtatgcagattcttcataatacagattattcaccgcgttgtgagtaactttcacttccgtaatacataaacatgcttcatcatttaaataacgttgcgttaacaaatatgccctttgtcctgccagcattctcgcaccggaaaagatgtcatgaaaggcagcgacaatttcaacaattatgggcgtgaatactggattatgtgcgctacctcacgcacaataatcacactgtcacaatattgacaaactttgccccatgcagggcagaggcgccacacctgcaggagaacacgattaatgccatcactcagtaaagaagcggccctggttcatgacgcgctggttgcccgggggctggaaacgccgctgcgcccgcctatggatgaactggataatgaaacgcgaaaaagccttatcgcagggcatatgactgagattatgcagttgctgaatctcgatttgagcgatgacagtctgatggaaacgccgcatcgtatcgctaagatgtacgttgacgagatttttgctggcctcgactatgctaatttcccgaaaattaccctcattgaaaataaaatgaaggtggatgaaatggtcaccgtccgcgatatcacgctgaccagcacctgtgaacatcacttcgtgatcattgatggcaaagcgaccgtcgcgtatatccccaaagattccgtgatcggcctgtcgaaaattaaccgcatcgtgcaattcttcgcccagcgtccgcaggttcaggaacgtttgacccaacaaattctgacggcgctgcaaaccttgctcggcaccaataatgtagcggtatcgattgatgcggtgcattactgcgtgaaagcgcgcggtattcgtgacgcaaccagcgccacgacgacgacgtcgctgggcggattgtttaagtccagccagaatacgcgccaggagtttctgcgtgccgttcgccatcatccatgattaaggcggagacgatggagcgtaatgtcacgctggattttgtacgtggcgtcgctatcctcggtatcctgcttcttaacattagcgcctttggattgccgaaggcggcttatctcaatcccgcctggtacggcgcgatcgttcccgaagacgcctggtcctgggcgattctcgatattgtggcgcaggctaagtttcttacgctgttcgcgttgttgtttggcgcggggctacaaatgctgcttccgcgtggtaaacagtggattcagtcgcgcttaacgctattggtactgttaggttttatccatgcgttattcttttgggacggcgacattctgctggcctacggtctggtcggattaatttgctggcgactggtacgcgacgcgccttcggtaaaaagcctgttcaataccggcatactcctttatctggtcgggattggcgtactactgctgctgggtgtggtatcgagtagcgaaaccagccgcgcctggacgccggatgcgtcggcaatattgtatgaaaaatactggaagctgaacggcggcatggaggctatcagcaaccgggcagagatgctgtcaaatagtttactggcgctcggcgcgcagtatggctggcaactggcaggtatgatactgctgggcgccgcgctaatgcgtagcggctggctgaaaggccagtacagtctgcggcactatcgccgtaccggggttctgctggtggcgttagggctaatgatcaacctgcctgcggtcattttacaatggcggctggactgggcgtaccgctggtgcgccttcttattgcaggcgccgcgcgaactgagcgcgccgttgcaaacgctgggctatgccgcgctgatgtttggcttctggccgcagcttagccgatgcagactgacgcttgccattgcctgcgtagggcgaatggcgctgaccaattatttgctgcagacgatcatctgtaccacgctgttttatcagtttggcttatttatgaaattcaatcgactggaactcttgttctttgtcgttccggtatgggcaataaaccttctcttttccgtcatctggctacgtttctggcgacagggaccggtcgagtggttatggcgtcaactcacgttgcgcgcgtcaggatcgctcagataacgatctggatcacattcattaacaaaatggctgtaaccgtttccatccctgtgatgtttctcacgcagccctgggcagggtgctgacaaaatagccgcctgctaacggggcatttgtgagcatttttgaactcaaacagggcagtgaatatgatcaccattcgtgatgtagcgcgccaggctggcgtgtctgtagcgaccgtttcccgcgtactgaataacagcgcgttggtcagtcccgacacccgtgacgccgttatgcaggccgtcaccctgctgggatatcggccaaatgcgaatgcgcaagcgctggccactcaggtgagcgataccatcggcgtcgtagtcatggatgtttccgatgcctttttcggcgctctggtgaaagccgtagatctggtcgcgcagcagcaccagaaatatgttctcattggcaacagttatcatgaggcggaaaaagagcgccatgcgattgaagtcttgatccgtcagcgttgtaacgcattgattgttcactcaaaagccttaaccgatcgcgagctgagcgactttatggatcagatccccggtatggtgctgattaaccgtatcgtgccgggttatgcgcatcgttgtgtctgtctcgacaatgtgagcggcgccagaatggcgacccgaatgttgctgaataatggacatcaacgcatcggctacctggccttcagccaccgtattgaagatgacgcgatgcgcagagaagggtggttacacgcgctgcaagagcagggggttgctgcgtcggagagctggattggcaccggcacgccagatatgcagggcggcgagtcggcaatggttgagttgctgggacgcaatctgcaactgacggcggtatttgcctataacgataacatggcgtcgggcgcgctgacggcgttaaaagataacggcatcgccattcccttgcatctgtctgtcatcggtttcgatgatatccctattgctcgttataccgatcctcagttgactaccgtgcgctatcctattgcttctatggcgaaaatcgcgaccgagctggcgttacagggggccgcaggcacgctggatatcacggcgacgcactgcttcatgccgacgctggtacggcgccattcggtggcgtggcgacagaatgcggtactgatcactaactgattacgccccgcatgtaaccgttttcaatctgtgagtaaattcacagtttattaacattgtgatagctatgatgacaacgtttgtcgcactgtaactaatgtgtaacagttagttgttagttttgctggggtatttcgcttataaaaaccattatcacaatatcccgcgactaccggacaaaaataaagagttgaataagagcttatcccattagggctattttacttgccattttggacctgggcagtgctcgccaaaacgcgttagcgttttgaacgccgctagcagcggcccgaagggcgagcgtagcgagtcaaacctcacatactacgtgtacgctccggtttttgcgcgctgtccgtgtccaaactggctgcgccaataacgcctggtgggataggctctaaatacgcttcggcgttcagtaacatgcgttaacgtgctgaacagccgggcatttttttacgctataccctacataataaaaccggagctaccatgaataagaaggtactgaccctttctgccgtgatggcaagtctgttattcggcgcgcacgcacacgcggctgatactcgtattggcgtgacgatttataaatatgacgataactttatgtccgtggtgcgtaaggttattgaaaaagatggcaaatccgcgccggatgttcagctactgatgaatgactcgcaaaacgatcaatctaaacagaatgatcaaattgacgttttattggcgaaaggggttaaagctctggcgattaacctggtcgacccggcagccgccggtacggtgattgagaaagcgcgcgggcaaaatgtgccggtggtgttctttaacaaagagccttcccgcaaagcgctggacagctatgacaaggcgtattatgtcgggactgactctaaagaatccggtgtgattcagggcgacttgattgccaaacactggcaggcgaatcagggttgggatctgaataaagacggtaaaattcagtatgttctgctgaaaggcgagccggggcacccggatgctgaagcccgtacgacgtatgtggtgaaagagttaaatgataaaggtattcagaccgagcaactggcgttagacaccgctgtgtgggataccgcgcaggcaaaagataagatggatgcctggctgtctggcccgaacgctaacaagattgaggtggttatcgcgaataacgatgcgatggcgatgggcgcggtagaggcgctgaaagcgcataataaatcgtcgattccggtctttggcgtcgatgcgttaccggaagctttggcgctggtgaaatcgggcgcgatggccggtacggtactgaatgacgccaacaatcaggcgaaagcgacattcgatctggcgaaaaacctcgccgaaggcaagggcgcggctgacggcaccagctggaagattgagaacaaaatcgtgcgcgtgccttatgtcggcgtggacaaagacaatctgagcgaatttacccaaaaataacttttccgtctgtgggcgcaattttgttgcgccctgaaaccgtggaagggtgacgtgccgcagaccggataacgtatttcttttgccatccggcgcggatagtcataattaaaaaggccgacagggtatcattatgggcagcacgatctctccgtcgtcgggtgaatatttgttggaaatgcgtggcattaacaaatcatttcccggcgtgaaagcgcttgataatgtcaacttaaacgttcgtccgcactctattcatgcattaatgggcgaaaacggcgcaggcaaatcaacattattaaaatgtcttttcggtatttatcaaaaagactccggcagcattgtatttcagggaaaagaagtggacttccattcggcgaaagaagcgctggagaatgggatttcgatggtacaccaggagttaaacctggtattacaacgttcggtcatggataacatgtggctggggcgttatcccaccaaaggtatgtttgtcgaccaggataaaatgtaccaggataccaaagcgatatttgatgagctggatatcgatattgacccgcgcgcgcgtgggaacgttatccgtttcgcaaatgcagatgattgaaattgcgaaggcgttttcctataacgctaagatcgttattatggatgaaccgacctcatcgttaactgagaaagaggttaatcatctgttcaccattattcgcaagctgaaagaacgcggctgcggcattgtttatatctcgcataaaatggaagaaatttttcaattgtgcgatgaaattactatcttgcgcgacggtcagtggattgccacccagccgctggaagggctggatatggataagatcattgcgatgatggtcgggcgttccctgaaccagcgctttccggataaagaaaataagccgggcgacgtgattctggaggttcgtcacctgacctcgctgcgccagccttccattcgcgatgtctcctttgatttgcacaagggcgaaattctgggcattgccggtctggttggggcaaagcgtaccgatatcgtcgaaacgctgtttggcattcgtgagaagtcgtccgggacaatcactttacatggcaagaaaattaataatcacactgcgaacgaagcgattaaccacggttttgcgctggtgacggaagagcgtcgttccaccggaatttacgcctatctggatatcggatttaactcattaatttcgaatatccgtaattataaaaataaagtggggttactggataattcccggatgaaaagcgacacccaatgggtcattgattccatgcgggtaaaaacgccggggcatcgcgcgcaaattggttcactttccggcggcaatcagcaaaaggtgatcattggtcgctggctattaacgcagccggaaatattaatgctggacgaaccgacccgcggcattgatgtcggcgcaaaatttgaaatttatcagcttattgcggaactggcgaaaaaaggcaaggggatcatcattatatcttctgaaatgccggagctgttagggattaccgatcgtatcctggtgatgagtaacggtctcgtttccggcattgtcgatactaaaacaacaacgcaaaacgaaattttgcgtcttgcttctttgcacctttaagatcaggggctccttatgagtgcgttaaacaagaaaagctttttgacctggctgaaagagggcggaatttacgtcgttcttttagtgctgctggcgattattattttccaggacccgacttttttaagtttgctgaatttaagtaatattctgacgcaatcttcggtacgtattattatcgcgctgggcgtggcgggactcatcgtcacccaggggacagacctgtcggcggggcgtcaggtagggctggcggcggttgtggcggcaacattactgcaatcaatggaaaacgccaacaaagtgtttccggaaatggcgaccatgccgattgcgctggtcatcctgattgtctgcgcgattggcgcggtgattggcctggtgaacggcatcatcattgcttacctgaacgtgacgccgtttattaccacgcttggcacgatgattatcgtttatggaatcaactccctttactatgactttgtcggcgcttcgcccatttccggctttgacagcggcttttccacctttgcgcagggctttgtggcgatgggcagttttcggctctcctacatcaccttttacgctctgattgcggtagtgtttgtctgggtgctgtggaataagacccgctttggtaaaaacatttttgctattggcggcaacccggaagcggcgaaagtttctggcgtaaacgtggcgctgaacctgctgatgatttatgcgctctccggcgtgttttatgccttcggcggcttactggaagcagggcgtattggttctgccaccaacaacctcggctttatgtatgaactggatgcgattgccgcgtgcgtggtcgggggcgtatcgtttagcggcggagtggggacggtcttcggcgtggtgaccggcgtcattatctttaccgtcatcaactatggcctgacctatatcggggtaaacccgtactggcagtacattatcaaaggcggcattatcattttcgccgtggcgctggactcgctgaaatacgcgcgtaagaagtagttatccagacgtattaccttgcttatcagataacccggcgcagcgaaactgcgcgccgggcttcataccgtgagctacagcgttaacgcgtgttctttttcgccttttttaaatttgacctcgcctaaatcaatacaggcgaccgggcagacatgaccgcacagcagacaaccgacgcatttttccgtattgcaatgcggcgtgtggctgtgttcatcccactccatcgcctgatgaccgccgtcatagcaggagatatagcaacgtccgcagccgacgcatttctcctgattaatccgcggatagacgatatagctgcgatccaggtcttccgccgggataatattgccattcgccagcccgatcatctcctgtaatgaggcaaatccctgatcggccagatagtggctgaggccgctcgccatatcttctacaatgcggtaaccgtattgcataatgcctgtcgtcacctgtagggtcgccgcgcccagcagcagaaattcggcagcgtcttcccaggtttcaatgccgccgataccgctaatcgggaaatcgcgcagttcagggtgcattcgcaactgctggataaaacgcagcgcaatgggtttcaccgcttttcctgaataaccggagatgctggatttaccgttaaccaccggcatcccgattttgcggttcaggtcgatgttagtaatggatttcacggtgttgatggtggcgataccgtcggccccgccgcgtttggcggccagcgcgacttcacacatatcgccaatattcggcgtcattttcgccagcattggcaaagatgaaccgcgttttacggcgcggcagtatttttcaaccagttccgggctttgccctacatcgcttcccatggcgtgcgaggtcatctgcgggcaagagaagttacactcaatcatatccgcgccggcttcttcaaccagacgcgccagttcctgccactgctgctcattttcccccatgatggaagcaatcagcaccttatccggataatcctgttttagccgtcgaatggcggccagattctcttccagcggatgctcagcaatttgctccatgtttttgaaaccaataaaaccggtatcttctttcgtcaggtggtcaaaacgtggagagacttcgttggcaataaaaaaccaatggttttaaaaacgatcccgccccagccggtatcataggctttggcgcacatctcataacaattgcctaccggagaagaagaaaggcaaaacggattgggaaacttaacgccgcaaaaggtaacagacaaatcttttgttaacatgagcaggcctcctctaaataatgatgaatagcctgagcggcttcttttccggtttttaccgcataaacgacggtcttatcacctttaacaatatcgccagcggcaaagatcgccgggtcgtcggtttgataattgtgcgtgtcgataatattatgctgcgcttttatctccgcaaagttatccagtcgcgcgtgctgccccacggccaaaataatattttccgcttccagcgtcagttctcctgagtggcgtacatggtggaaggtcactttatttccgctgacggcgacaggcgtaaaaccatcaataatcgatacgcctaatgcctgcgtgctggtaaattctttttcgctggcggggaattcggctaattcttcccgcgccacgcaggtgacggaaggacagccgagaatttttaacgtactggcgacatccatcgctacgtcgccgccgccaataattaatgcgctacgcggaacgctaatatcgccgtcggcctgacgggcgcgctgtaaaaaatcaacggcaatctctacgtgactggcttgctcaaataacggtaaatcagagccacaggacatcccgacggtcatcagcacggcgcgatattcggctttgagttgcgcaagcgatagcgacccgcccacgtcacaattacatttaatattgacgcccatttctacaatgcgggcaatttcctgatcgagtacgctttgcggcagacgaaatgccgggatgccgtgacgcagccatccgccgggctgcggctgtttttcgtaaatggtgacgtcatagcctaaatgtgtgagcgtcacgcttgcctgcaaacctgccggacccgcgccaataatcgcgactttcccgcgtgttttactcccgggctgataaatctgcatggcagtctgctgttcaaaatcggtaataaaacgttgcaggcgtgcaatatcaataggtttatctattccggaacgtgtacatccgcgctggcataatttttccgtcggacagactctggcgcagacggcgccaagcgcattattttcccggatagtttccgctgcgcctttaaaattgcgaaagtaaatagaacgaataaatttccccggatcggtttgcgccgggcaagcctgactacagggcgcatcgtgacataataaacaacgggaagcctcttttattgccagtaatggcgtaaaaccaggcgtgagttcatccagataattttgttgcggcatataatcttccttaatgcttgaataaattaaggcgaaacgcaaataacgcgttttaatgatctaaaatctaccgccagcctaagcattgaaagaagggcattctgtgaaagaattcacaaaaaaatgaaaccagaatgcaaaacagcatttgttccttatatcataataataactattctcaattttaaagggataataaatagattaacgataaaaaagaagataaataatcattccagtaaataaaaaaccgcaaccggtataaagaaaaagataagaccaatattgtacgggatcggcatggcgataaacataaaccggttttcgcgcatttttgacaactttatctaccgcgtcggttcgccagcctttccaggcctcacgaaagcaaaaaagcgggagtagcagaaaggctaatatgacaaatatcgtctgtacatccatgatcatttcccttttttcttttccagttcaagcaattgttccggcgtaacggccggatacccctgggcgtcatttggcacctgatgctgcgtgggaataggtaccagcgggcctaaaaaacgcggttcgcgtttaaaaatatagagatccgccagcgcgctaaagcgggcgccaaattcgcgcaagcgtactgtcagcatatttttgggtgaaggtaccgcgtaacactgcgcctgaatgcccatatgcaacgcaataaacaaggcgcgttcgcagtggaagcgctgagtgatgataataaagtcgttgatatcaaacactttgcgggtacgcacaatggagtcaagcgtacggaagccagcgtaatcaagcacaatgtccgcaggatcgacgcccgccgcgataaggtctttgcgcatggtcatcggttcgttatagctttgcagggcattgtcgccgctgagcagcaggtaattgactttaccgctattgtaagcgtttaacgcgccctggatacgataacgatagtactgattaatgacacccttgcgatagtatttggctgtccctaacacgacgccaacctggcggtaggggagatcctgtagctcgtcatagatatagggcgctgttttccagctcatccaccgatcgaggccaagcaccgtcaacagcagcaagcttaccaggaccaacaggctgtaaaacacgcgctttaacatgcaggaaactcgataccaggatgaaagtacgatcaggctactgtacccgaagacgtagcgcaagaaaccgccgtctgattgcggagattttcagcatgatttcccttgtatcgggtcgcgggagaggagagtcaggccggataagacgccagtgcgtcgctatccggcacatttgcttagccgagaagcacgcggtcaatattatggcaacctaacgctttcagcgttgcggcggtggcatcccattgaattaatgccgcatcgcctttttccgccagaatcgcgcgctgaatatccgcatagtcatagtcattgagactcagcaggtttagcgcgccttgcagtgggggaagcgtagggttaaaggcggcgttttccgcatagctgccggtgaaaatacggccatctttacattccagcgccacgccgctcggtgagtggctataaggcatatggctcttattggctgccgtaatcgccgcttgcgttagcgtattgcccgttaacgtaaagccatgatcctgctcgtccatcagcagcgttttgatctccagatcttttggcccgaaagcgtcaggcagataatcgcgtaacgtatgcggcgcgcggcccggcagatgaatgcgcagatccagaccgctgttcagctcgttcataaactggcgacagtggccgcaaggcgtgtagttaacggtgacggcggcgagccctttttcgccgcgtagccaggcgtggctaatcgcgctttgttcagcatgcacagtttgttgcatggtggcgcccaggaactccatattcgcgccgaaataccagttgccgctaacgccgcgcgcaatcgcgccgacgttaaaatgggacaaatcggtacgggcgcaggccgccgccagaggtaacagtgcgaaagccagcgcgtcttcgtccagtcccgccgtatttttaagcgtcgagacctgctctgcggtcagcatggcgggaaaatggtggtccgccaggataggggccagcgctgattgcaaattatccgcaagctgggcaaaagcagtttgaaaacgtggatgcatggcgttgcctcataacaatgtaatggaaccgtagtttacgggcctgccatgtcttaatatgtgatctaaatctcattgcttatgcaacttgtgaaacttaaatgaaaaatacgcgacgtatcgcaaattttaacccggtcttttgtcccgtcgttagcgcattaccgccagaatgagcggaaacaaaaagggcgctaccagcgaggtaataatgccgcagatcaccagcgccagggagctaaacgcgccttcctggtaatccagctcggcgcagcgcgcagtaccgagcgcatgtgaggcggtccccattgccagcccgcgtgcggctttagtacggatgtgcatcgcgtttaacagcgtgtggccaaacaccgcgcccagaataccgacaaaaattacgcataccgcgctgatcgcggggatgccgccgatgctgccgcccaccgccatcgcgataggcgtagtcacggatttaggcagtaccgatgccgcgatttcaggcgttgcgcccatcagcaaggcaacggatgttccggtaatcatcgctaccagactgccgacaaaacagatgctaataatggatttccaacgcgcgcgaatctggtgcaactgttcataaaggggataggccagcgccaccaccgccggttgcagcagatcgttaagtacttcgctgcctttgaagtagtgctcgtagggaataccggtcagcaacagaaaaggaataatgactaccattgccaccagcagcggattcagcaacggcattttaaaatgcgccgccagtctgcgggcggcgaaaaataccgccagcgtcagcggtaacgaccaccagatatatgtcatcattttttcgttcccttctgcccaaccactttacgctcaccgtgtatcagatgtgaactccagcttacgaccacaaaaacgaccagcgtactgatagcgcaagagaccaccaccgggccgaattgcgcgcgcagtaagtcaaaatattgcatgaccccaacgccaattggcacaaacagcaatgccatataacgaatcagcacataacagccggggttaacccactttgccggcagaatttgcagcgccagcaatacaaacagaattaacatcccgataatgctgccgggaatagtgataggaagcagtgatgcaagaaaaatgcctgcgtacaaacaggcataaatcaatacaaaagcgcgtatatattgccagataatattcagtgacttactcatgtttaaagcccttgatgagatggattcatcatacaattaaacgttaaaacgtgctaccgatcacatcatgaattcttagcatagtgggtatagacagcaggaacatcgggcaatgcccctggtcggcggcgttaaacctgggctaaaaaatacaaaaagcgactcagggccaaagacggcgtctcattcttacgccagaacatccctacgctgcctttttgctcaatttttggcaagtttaaaatcgccagttgcccctggctggcatagcgttgcgccagccgtaaagaaagaatagagatcatatcgctgctttgcagcaaattggtgctgacgttcattgacgccgattcaatggtgttttccgggagcatgacgccattatcgacgagggcgttatcaatactgatgcgaataggggtgccggttggccagactatccaccgccagtgtgccagatcgctccaggcgatctgcgctcgcgcggccagcggatggtgcggacgcgccacaaagcagaccggctcggtataaagtacctgataattaagcggcagttgcagggcgcggccgccgacacgccctaccaccacatccacctgaccggcaagcaaatcgtgcagcagcggcgtcattaccttctcttcaatattcagatgcagcgtcggcatttcgttaagcaggctcagaatcgcctgtgatacgcagtcagtcgccacgggcgaacagccgatcttcaggctgccaaccaggccgccctgcttgaaacgggcgatttcatactgtgaacgctccagatcgttaattaggcgctgggcgtgctggagcagtaatttaccgccttccgaggggcgtagtcctttactgtggcgctcaaaaagcgtgatgcctatctcatcttcgagttgagatagccacttcgatagcgccggctgggagatattcatcatccgggcgacgtgcgtcaggttgccctgttcgcccagcgcaaccagcgtttgcaggtgatgtaatttcaatttctgcgcccagttcgccattcgctataacctccaggttatgtctctgcctgaaaagccattgtacattttatcgctcactctacaaactcgtaacatagcaaacataaaaacaacatctatctccctgcactgaggcattagctatgactcaacgacgtgatctacaagcccttattgatgccgcgcccgtcggcaaaatgcagtggcgcgttatcatctgctgttttctggtggttatgctcgacggtttcgacaccgccgcgattggcttcatcgccccggatattcgtactcactggcagctaagcgccagcgaacttgcgccgctgtttggcgcagggctgctggggcttacggccggcgcgctgctatgcgggccgctggcggatcgctttggccgcaagcgggtcattgagctttgcgtggcgctattcggcgcattgagcctgctttccgctttctcgccggatatagaaaccctggtgttgctgcgcttcttaaccggtctgggactgggcggagcgatgccgaataccatcaccatgacgtcggaataccttcccgctcgtcgacgcggagcgctggtcacgctgatgttctgcggttttaccctggggtcggcgatgggcgggattgtgagcgcgcaactggtgccgctgattggctggcacggaattctggcgctaggcggcatcttgcctttgatgctgtttttcggcctgctgttcgcgctgccggaatctccccgctggcaggtacgtcgccaactaccgcaagccgttgtcgcccggacggtcagcgccattaccggcgagcgctatcacgatacgcaattctttctgcatgagacggcagccgtcgccaaaggcagtattcgccagctttttgccgggcgacagcttgtcattaccctgatgttatgggtggtgttctttatgagcctgctcattatctatctgctttccagctggatgccgacgttacttaaccatcgaggtattgatctgcaacaggcgtcgtgggtgactgccgcattccaggtgggcggcacgcttggcgcgctgttactcggcgtgttgatggaccggcttaacccgttccgggtactggcggtgagctatgcgctgggcgcagtttgcattgtcatgataggcctgagcgaaaacggcctttggctgatggcgctggcgatttttggtaccggcatcggtattagcggttcccaggtcgggctgaatgctctgacggcgacgctgtaccccacccaaagccgggcgacgggcgtgagctggtcgaacgccattggacgctgcggggcgattgtcggttcgctctccggcggcatgatgatggccctcaatttctctttcgatacgttgttttttgtcattgctattccggcggctatcagcgcggtaatgcttaccctgctgacagtggttgtccgcctttcgatttctgtacctgacgacctgccgcgtgccagcgtcgtaaacgaataaggagaatctccatgtctgaaataaatcagaacgtaaaagatagccgtcagcagtattaccagcatatttccgggcagaatctgacgccgctgtgggaatcgttacatcacctggtaccgcagacgccaaacgccaactgcgcgccggcctactggaattatcaggaaattcgtccgctactgatggaaagcggcaatgtcattggcgcgaaagaggcgatccgccgggtgctggtgctggaaaatccggcattgcgcggtcagtcgtcgatcacggcgaccttatacgctggtttacagctgatcctgcccggcgaagtcgcgccgagtcatcgccataaccagtcggcgctgcgttttatcgtcgaaggtaaaggcgcatttaccgcggtggacggcgagcgcacgccaatgcataccggcgattttatcctgacgccgcagtggcgctggcacgatcatggtaatccgggatcagagccggtggtatggctggatggtctggatctgccgttagtcaatctcctgggctgtggttttgcggaagactatcccgaagatcagcagccggtgacgcgaaaagagggcgattatctgccgcgctatgcagcgaatatgctgccgctgcgccaccagcgcgggaactcgtcgccgattttcaactaccgttacgaccgcagtcgcgaggcgttgcacgatctgacccgtatgggcgatccggatgagtgggaaggctacaagctgcgttacgttaatcccgtcactggcggttatccgatgccgtcgatgggcgcgttcctgcaactgctgccaaaaggctttgcctcgcgtgtggcgcggagcaccgacagcactatctaccacgtcgttgaaggggcagggcaggtcactatcggcaacgaaacttttcatttttccgcaaaagacatttttgtggcgccgacctggcatgaggtgtcgtttcgcagcagcgaagacacggtgttattcagcttttcggacaagccggttcaggaagccctggggctgttccgcgaagcacgttattaattagggagagagaacatgaccaaatatgtattccagccgcaggccccggtgacagtacccgtggcgggcagtgatgagcagtttccggtacgtcgcgtttactgcgtgggtcgcaactatgccgcccatgcccgtgaaatgggttttgatcccgatcgcgaaccgccgttcttcttttgtaaaccagcggacgctgtcgtcccggtagcggcgggggataccctggaactgccgtatccggcgcagaccgataactaccattatgaaattgagctggtggtggcgattggtaaaaaggggagcgatatcccgctagaaaaagcccatgaatatgtctggggatacgccaccggtctggacatgacgcgtcgcgatcgtcagatggaaatgcgtcagatgggacgcccgtgggaaattggcaaagcgttcgatctctccgcgcccattgcgccattacacaaagccgctgaaacgcataatgtggataacgcccctatttggttacaggttaacggcgaagaccatcagcgcagcgatattcgtcatctgatttggtcggtgaatgaaaccatcagctatttgtccggcttttttgaattgcagccaggcgatttgattttcaccggtacgccagagggggtgggcgcagtggtgaaaggggatgtcatcaccgggaacgtagaaggtctgacgccgattgctgtgaaaattgtctgaggtgaacgatgaagctgtacagtttctttaatagttcggcgtcttatcgtgtacgtattgcgctggcgttaaaggggattgattaccagacagtgggcgtcaatattcgtatcggccagcagaatgcgctggcctaccgacggatgaatccggtaggcctggtgccgacgctagtcactgatgacggcgaatcgttggggcaatcgctggccatcgtcgactggctggaccgacattttccgcaaacgccgctgctgccgacgagcgacccggcgcgcagccaggcgctggaaattgtctacgctatcgcctgcgatatacacccgatcaataacatgcgcgtgttgcgctacctgaccgatgagctgaaggttagcgaagaggataaaaaacgctggtacgcccactggatacagcaagggttaagcgcggtagagcagctattgcgtaaaagtcagtccggacgattctgcgtgggcgacgcgccaggccttgcggactgctgcctgattcctcagtgggcgaatgcgctcaggatgggctgcgatttatcaggctatccgcgctgtaaagccgtttatgacgcctgcgtacagctaccggcgtttattgccgccgcgccggaaaatcaacaagataaaatcccggcctgaaaaggagaatgaccatgactcacgtgacaagcgcaattattgtaggtggcggaatcggcggcgcggcgaccgcgctgtcgctggcgcgccagggaataaaagtcatgctgctggaaaaagcgcacgaaattggcgagattggcgcgggtattcagcttgggccgaacgctttttcggcgctggatagtctcggtgtgggcgatgttgcccgccagcgtgcggtgtttaccgatcacattaccatgatggatgccgtgaatgccgaagaagtggtacgcattgaaaccgggcaggcgttccgcgaccattttggcgggccgtatgcggtaattcaccgggtagatattcatgcaacggtatgggaagcggtgctgacgcaccctggcgtggagtatcgtacctcgacccatattgtcgatatccgccagacgccggatgacgttacggtgtttgatgagcagggaaatagctggacggcggatattctcgtgggctgcgacggcgttaaatcggtcgtgcggcaaagtttactcggcgacgcgccgcgcgtaacggggcatgtagtctatcgggcggtgattgattgcgacgatatgccggacgatttacgtattaacgcaccggtgctgtgggcaggcccgcattgtcacctggtccattatccgctgcgcggaggccaacagtacaatctggtggtgacattccacagccgccagcaagaagagtggggcgtgaaagacggcagtaaagaagaggtgctctcttattttgccggtattcatccccgcccgcgtcagatgctggataagccgacctcctggcgccgctggtcgaccgccgatcgcgagccggtcgcaaaatggggaaccgagcgtatcactctggtgggcgacgccgcgcatccggtggcgcaatatatggcccagggcgcctgtatggcgctggaagacgccgtcacgctaggcaaagcgctggaacgctgcgacggcgacgcgcagcaggcatttgcgctgtatgagtcggtgcgtattccccgcacggcgcgtatcgtctggtctacccgcgagatggggcgtctctatcacgccgccggggtggagcgtcaggtgcgtaatctgctgtggaaagggaaatcgcaggaggcgttttatcgcggtatcgaatggctgtacggctggaaagaagataactgtcttgagccgcgttgagcgccttacgtgacgtagcgtggcgtttgcgccgccacccggcaaaaagttttgctcatcgcagagaggcgttatgatagcgcctctttttttgctgtggataccgatatgcgtgttttactggcgccgatggaaggcgtgctcgacgcgttagtgcgcgagctgctgaccgaagtgaatgattacgatctctgcatcaccgaatttgtgcgcgtggtggatcagctgctgccggtaaaagtgtttcatcgcatctgcccggagttgcttcacgccagccgcacgccgtccggcacgccggtgcgtattcagcttctgggccagcatccgcagtggctggcggaaaacgccgcgcgggcgacggcgttgggatcgtatggcgtggacctgaactgcggctgtccgtcaaaagtggtgaacggcagcggcggcggcgcgacattgctcacagatcccgaactcatctatcagggcgcgaaagcgatgcgggccgcggtaccgtcgcatctgccggtgacggtaaaagtgcgtctcggctgggatagcggcgatagaaaatttgaaatcgccgatgcggtgcagcaggccggcgccagtgaactggtggtgcatggccgtaccaaagcgcagggctaccgcgccgagcatatcgactggcaggcgatcggcgaaatacgccagcgtctgactattccggttatcgctaatggcgaaatctgggactggcagagcgcgcaggcatgtatggcgaccagcggctgcgatgcggtgatgattggccgcggggcgttaaatattcctaacctgagccgggtggtgaagtataacgaaccgcgtatgccgtggccggaagtggtaacgttattacaaaaatatacccgactggaaaagcagggcgataccggtttataccatgtcgcgcgtattaaacagtggttgggatatttacgtaaggaatatattgaggcgacagaactctttcagtcgattcgggcgttaaaccgttcgtccgagattgcgcgggtgattcaggctattaaaatctaatctctacagcgtccagaacgtgtgccgggcagatactatcgctgcccggcgcaggaatcagaaaatcatcttaaacacgcccgttaccaccaacagcccaatcagaaaaataattaagattgcccatagaagaattttcattgtttgtccctttattggtaaatacaaacaaagtataggaaagtattaagccatctgctgctttgttgggcgcggcgacgtttaactcatgaaggctgctggcgcgtattgcagcaaaatcgttcatttatgaacgggttagtgggacttttcattgaagtattacatcaaaaaatgtatcagatgaaattatttgctaatcatataaatttcaaaatatgtcttttgttgtctgatgatgtattgccacgcgtaactaaaaaatagttcgccgtaagacgtactctctgcgcacctttttttatcagaacacctccatgaatcgtaattctttccttgccgcgacagcgagcttaccgctttttattttgctggcgggctgcgcccctatgcacgatacccgccagtcgctgacccagcagacgccctcttctcatgttgattccagcctgccggcggcattgaaaaacggttggccggatagctagtggtggaaggcgtatcacgatgcgcagcttgacgcgctgattgataatgccatacagcattcgccggatatgcaggtggctgaacagcgtattcaactggcggaagcgcaggcgaaagcggttgaggcgcaggacggcccgcagctcgacttttctgccgacattgagcgccagcgaatgtccgcggaagggctgatggggccattcgcgattaccgaccccgcggcgggaacgaccgggccgtggtataccaacggtacattcggcctgacggcgggctgggatctggatttatgggggaaaaaccgcgctgaagttaccgcgcggatcggggcggtcaaagcgcgcgaagcggagcaggagcagacccgacaattgctggcaagcggcgtggcgcgactctactgggagtggcagacgcaggcggcgctgaaaaatgtgctgatgcaaatcgagcatgagcagcaaaacgtggtggcggtaaaccgggagctgtatcaacacggtattacttcttctgttgaaggggtcgagaccgatatcgacgccagcaaaacccagcagcagttgaatgacgttaacggtaaaatgaaggttattgaagcgcggctcagcgcgttaaccaatacgcaatcggcggcgctcaagctgcgtcaggtgagtctccccgccgttgaaagccagttaccgtcgcaactggggtattcgttgctggcgcgccgggcggatctacaggccgcgcactggtacattgaatcctcgttgagcagcattgacgccgcgaaggccgcgttttatcccgatatcaatctgatggcttttttacagcaggatgcgttacatctgagcgatctgttccgccattccgcacagcaatatggcattaccggcgggctgacgctgccgattttcgacagcggcaggctgaatgccaacctcgatatcgccaaagcgcaaagcaacctttctatcgccaactacaacaaagcggtggtagatgcggttaatgatgtggcgcgcgccgccagtcaggtagagacgctggcgcagaaaaatcagcatcagcagcagattgagcatgacgcgcagcgtgtggtcggtctggcgcaagcgcgctttaatgccggcattattgcgggttcccgcgtgagcgaggccaaaatcccggcactgcgcgagcagtgtaacggcttgctgttgcagggccagtggctggatgcctctattcagcttaccagcgcgctgggcggcggttatcattcctgatttttccagatgattcagacagggttcctatacttaggctgtgtatgattcatccggagaggaatatgaccaaagtcgcaattgtaacggcatcagattcgggaattggcaaagcgtgtgcgttgttattagcacaaaacggttttgatattggtatcacctggcattccgatgaacgcggcgcgcaggagacggcgaaaaaagcggcgcagtttggtgtgcgggcagagaccattcatcttgacctgagccagttacccgagggcgcgcaggccattgaacatcttatccagcgcctggggcgcgttgacgtgctggtcaataatgccggggcgatgaccaaatccgcgtttattgatatgccgtttacgcagtggcggcaaatttttaccgtggatgtcgatggcgcgtttctctgcgcgcagatcgccgcccggcatatgattaaacaaggagagggagggcgcattatcaacatcacctccgtccatgagcatacgccgcttccgcaagccagcgcctataccgcggcgaaacatgcgttggggggattgactaaatccatggcgctggaactgattgagcatcatattttggtcaacgccgtcgcgccaggcgctatcgccacgccgatgaatgatatggatgacagcgacattgagccgggatcggaaccctcgatccctatcgcccgaccgggttctacgcatgaaatagccagcctcgtcgcctggctgtgttcggaaggcgcaagctataccaccggtcagtcgctgattgtcgacggcggatttatgctggtgaatccgcaattcaacgcaaaataaacgccggggccggatggcggcgttatgccatccggataccatcgggtttaacgggcctccgctttgccgcgtcttttcagccaccagcgcacgcccaccaccaggacgatggccagaatcagccagactccgtgcctgagatgctgatcgaggtcgtgcagccatggcgcgatcacctcgccgccaagatatcccagcgtggtaaacagcagcgcccagatcagcgcgcctacaatattcagcggcagaaaaattttaggcggcaggcggctggcgccaatcagcagcgggccaaccacccggaagccatacataaaacgcgtgccgatcacaaacagatacggatggcgttggatcattttctgcgcgcgacgaatcttcgtatgataacgcgggaaacgacgcaggatcttcccgccatagcatcgtcctaacaggtaaagtagctgatcgcccatcatccctcccagcgcgacggccgccgccaccagcggaaacttgagtaatccctgatgcgccgcgacgccccccaacagggtaacggtttcaccttcggccatactgccgataaccagcgccgcatagccataatgcgtaataagcgtgttgatatccatgcgtaaaccacctccggcattaagcatacaccctggcaagaggcgtgcgcggcaaagccgacgttttgccggagactattttgccattgctcataaaataaccagaaactgaattatacttgaacatactggcatctgaggcagcagaagggggcagtatgaaccatgtatgggggcttttttcccatcccgatcgggaaatgcaggtgatcaaaagcgaaaacgaaaccgtttcgcatcactatacgcaccatgttttgctgatggcggcgattcccgtcgtctgcgcctttatcggcacgacgcaaatcggctggaattttggcgacggcaacgtgttacaactctcgctgtttaccgcttttgcgctggcggtcttgttctacggcgtgatgctggcgggcgtcgcggtgatgggacgcgtcatctggtggatggcgcgaaactatccgcaacggccatcgcttgcgcgctgtatggtttttgccggctatgtcgcgacgccgctgtttttaagtggtctggtggcgctctatcccctggtatggctatgcgctttggtcggcgctgtcgcgcttttttacaccggctatttgctgtatttgggtattccgactttccttaacattaatagagaggagggattaagcttctccagttcgacgctcgctatcggcgtactggtcctggaggtgctgctggcgatcaccgtgatcctgtggggatatggctaccgcctgttctgatgcgaaaaagggctggcgcaaaagccagcaatgcagcatttgctgacgattcttctgtagcggcaacgctggcgtgccgctatgatgccactgctagcttgagtataatcttagctcaggcggtgtgcgttacgacgcgcgtgaatcattatcagaaatctcatcatgctgaaattctgagcttcattcctgagccttgctctgatgttggccgttccttttgccccgcaggctgtggcgaaaacggcagcgacaaccgcggcgtctcaacctgagattgcctccggtagcgcaatgattgttgatctcaacaccaataaagtgatctattcgaaccacccggatctggtgcgtccgattgcctcgataaccaaattaatgacagcgatggtcgtgctcgacgcgcgattgccgctggatgaaatactgaaggtcgatatcagccagacgccggaaatgaaaggggtttactcccgcgtgcgcctgaacagcgaaattagccgcaaaaatatgttgctgctggcgttgatgtcatccgaaaaccgtgcggcggcaagcctggcgcactattatcccggcggttataacgcatttattaaagcgatgaatgcgaaggcgaaagcgctgggcatgacgcatacccgctttgttgagccgacggggctgtcgattcataacgtctcgaccgcgcgggatttaacaaaattgctgattgccacgaagcaatacccgctgattggccagctaagcaccacgcgcgaagatatggcgacattctcgcatccggcgtatacgctgccgtttcgcaataccaaccatttggtctaccgtgataactggaatatccagttaacgaaaaccggctttaccaatgcggcggggcattgcctggtgatgcgtaccgtgatcaataacaaaccggtcgcgctggtggtcatggacgcgttcggcaaatatacccactttgcggacgccagtcgcctgcgtacatggattgaaaccggtaaagtcatgcccgttccggctgccgcgctgagctataaaaagcaaaaagccgcgcaaatggcggcagccagcgccagcgccggagcgcaaaccgcacagaacgattaagtcgccgcaggcccggcaggcatcgcgccgccgggcattcacggtaaaccacaccgtgttaatgcgtttcgtcgggcgtattttcctgccagaatttccgcttactcgttttgccgataccggggttcatactgttggttgggtcattttgccgataaaaacgcgtcagcgtttccggcgctttatacagatgtccaacgttgtgctccgccgggtattgtgccccgcgcgcctgcaacagctccagcatttgcgctttcagcgcatggacgtcgacgcctttcttcacgatatagtcctgatgaaaaacgtggcacataaagtgaccgtaatagagtttatgtaccagttggctgtcgatttccggcggcagatgctcgaaccagtcggtatcgttgcggcgcagggcgatatccagcgccagaatatcttccacttcatcagcgtgtacggcctgataacgaatcgctgcgccagcagcggcgaagcggtgcaggaaggctttgctgccttcttccggcgtacaggtgaagaaaccgccctcagcggatttaaaaaattcattcagccagcgttgcgcttctgcgacgccgtctcccgccatttttaacagcagatgatgctcatatttatcgcgccagtttttcattcgcggcggcagatggctgggaaacagatggccgaatttctgcatcgcgcggtcggtgaaatgcggtcggaaaaattttactttttccagcatcgcatcggttcggccttttagcgtgaaaaagaatggcatcttgtcggtgccgagtttatcgatcatcagaaaggtatctttaccgtactgctccgcaatatcgtagatatcgcgatgcatatattctcccgccactggcagattgtcgaagttcgccagaatatgccgacggatttcagtcagtaccgcgggctgattggtgccgatataaaaaacctgctgatttttttccgctgcaaaggtatcaaggcgaacggcaaaaaccgccagttttccggcgcagccggaagattcaaacaaacggtccgggtcggcgttatagcgggcgggcgtatcggcgttgatatctcgtacccgcgtcacgtagtcgtgatcgtgcgcatgacgaccatcgtgacgcacatcctcatctttaatccgttcatcatccagcttgctcaggatctgctccggcgtatgcccaagatcgatacccagatgattgaccagttgcagtttgccttgctcgtcaatacgggcaaagagcgacatctcggtataggccgggccgcgctgcaccagcgagccgccggagttattacagatgccgccgatgaccgacgcgccgatacacgacgaaccaatcaccgagtgcggttcacggcccagcggtttaagcgctttttccagcgcatagagcgtcgtaccgggccaggccagaacctgttggccgttatccagtaagtgcagcttatccagccgctgggtgctgataatcacaatatcgcgatcgtagtcgttgccgttcggcgtggagccttccgtcagaccggtgttggcggcctgcatcagaataattttgtcagcgttaacgcaggcgttgagcacacgccacagttccagtaatgaacccgggaaaacaacggccagcgcgtcgccctgaccggaacggaaacccttgcgatagcgggcggttttggcggggtctgtcagcaggtgagaatggcctaccaggcgggccagctcattcaggaacgttttattatcagtcattgttatggaagacattctccactccttgtggtgggacaaaatatcagcgttaagcatagcgctttgtatgacaatacgctttctcattcaaattgtttctgtgttggtggtattcatttgccgccttgataccatttgctggcggttgcgtattcgactgtgcggaaaattaggagaataaccttcgctttcttctcctctcgcgtttaggcttatggcaaactgcggtttttattctgtttttaccgcctcgtcgggataaagataaagagagactcaacatgaaatggttatgttcagtaggtgttgctgtgagtctggcgatgcagccagcattggcggaaaacctgtttggcaatcacccgctgacgcccgaagcgcgcgacgcgttcgtcacggatttactcaagaaaatgactgtcgatgaaaaaattggtcagttacgtctgattagcgtcggccctgataacccgaaagaagcgattcgcgagatgatcaaagacgggcaggtaggggcgattttcaataccgtcacccgccaggatatccgtcaaatgcaggatcaggtgatggcattgagccgcctgaaaattcctctcttttttgcttatgacgtggtacacggccagcgaaccgtcttcccgataagcctcggtctggcttcttcttttaatctggatgcggtaagaaccgtaggacgcgtatcggcgtatgaagcggcggacgacggtctgaatatgacttgggcgccgatggtggatgtctcccgcgatccgcgttggggacgcgcctccgaaggctttggcgaagatacatatttaacctccatcatgggcgaaaccatggtgaaagcgatgcagggcaaaagcccggcggaccgctattcggtgatgaccagcgtgaaacattttgccgcctatggcgccgttgaaggcggtaaagaatacaacaccgtggatatgagttcccagcgtctgtttaatgactacatgccgccgtacaaagcggggctggatgcggggagcggcgcggtgatggtggcgctgaactcgctgaacggcacgcctgcgacgtcagattcctggctattgaaagatgtcctgcgcgatgagtggggctttaagggaattaccgtttccgaccacggcgctattaaagaactgattaaacacggtaccgcggccgacccggaagatgcggtgcgcgtggcgctaaaggcaggggtggatatgagcatggcggatgagtattacagcaaatatctgccgggtctgattaagtcgggcaaagtgacgatggcggaactggacgacgcgacgcgccatgtgctcaacgtaaaatatgacatgggattgtttaacgacccctatagccatctgggaccgaaagagagcgacccggtggacaccaatgccgaaagccgcctgcatcgtaaagaggcacgggaagtggcgcgggaaagtgtggttctgctgaaaaaccggctggaaacgctgccgctgaaaaaatcgggcaccattgccgttgttgggccgctggccgacagtcaacgtgatgtaatgggaagctggtctgctgctggggtcgcgaatcagtcagtgacggtgctggcgggtattcaaaatgccgtcggtgacggggcgaagatcctctatgccaaaggggcgaatatcactaacgataaagatatcgtcgatttcttaaacctgtatgaagaggcggtgaaaatcgatccgcgctcaccgcaggcgatgattgatgaggcggtgcaggcggcgaaacaggccgatgtagtggtcgcagtggtaggcgagtcgcaggggatggcgcatgaagcctccagtcgtaccaatatcaccattccgcagagtcagcgcgacttaatcaccgctctgaaagccaccggtaagccgctggtactggtattaatgaacggcagaccgctggcgctggtaaaagaagatcaacaagccgatgcgattctggagacctggtttgccgggacggaaggcggcaacgccattgccgatgtgctgtttggcgattacaacccgtcaggcaaactgccgatctccttcccgcgttcggtgggacaaattccggtctattatagccatctcaatacgggacgcccgtataatcctgaaaagccaaacaaatacacctcacgctattttgacgaagcgaatggcccgctctatccgtttggttacggtctgagctacaccacatttacggtgtctgacgtcacgctctcctcaccgacaatgcaacgcgacggcaaagtcacggccagcgtagaggtcacgaataccggtaaacgcgaaggggaaacggtcatccagatgtacttacaggatgtcacggcgtcgatgagccgcccggtgaagcaattaaaaggctttgaaaaaatcaccctcaagcccggcgaacgtaaaaccgtgagtttcccgattgatatcgaggcgttgaagttctggaatcagcagatgaaatatgacgcggaacccggcaagttcaacgtctttatcggcgtggattccgctcgcgttaaacaaggatcgttcgagctactgtaagcctgccgtcaacagggcgcgatagcagcgccctgtctggcaatgactttttctgtcccccccttttattgcctgccacgtcacttaaactgccggaaaatcccaggttaaacgcagacttttcaactatgcttttttctcaagtttctgaaaaaggccgtaaaaggatgaggaaagcatcatgacgatctcaaagctatgggtaagttcgctggcgttgctggcgacggtgagtttacctctacaggcggcatcgcccgtgacggtcgggtcaaagattgataccgaaggcgcactgctcggcaacatgattttgcaggtactggaaagccacggcgttaaaacggtcaataaaattcagctcgggacgacgccagtcgttcgtggcgcgattaccgccggagagctggatatctatccggaatacaccggtaacggggcgttcttttttaaagatgaaaacgatccggcatggaaaaatgcaaagcaaggctttgagaaagtcaaaaaactggatgcggagcagaataagctggtctggttgacgcctgcgccggccaacaacacctggaccatcgcgatacgtcaggacatcgcggaaaaaaataaactctcctcgcttgccgatctcagccgttatctgaaagagggcggcacttttaaactggcggcgtctgcggaatttatcgaacggtcggatgcgctgccggcatttgaaaaagcctatgattttaccttgaatcagaaccagctcttgtcgctggcgggcggcgatacggcggtcacgatcaaagccgccgcgcaacaaacatccggtgttaacgccgcgatggcgtatggcaccgacggcccggtcgccgcgctgggtctgcaaaccctgagcgacccgaaaggcgtccagcctatctatgcccccgcgccggtagtgcgtgaatcggtgttacaggcctatccgcagatagccgattggctgcagcccgttttcgccagccttgatgagaaaacgctgcaacagttgaacgccagaatcgccgtagaagggctggatgcgaaaaaagtcgccgcagattacctccgacaaaaagggtgggtgaagtaatctgtgagtgacgctgccaaaaaaattacggttaatcgtgtgctgttgctgttggttgttctggccctgcttgctgtcgcgctgcctttcattaattacgccccgaatcgtctggtgagcggcgaggggcgccagttatgggagatctggccggcgaccatctggatgctgactggcgcgggatgcgcgctgtttacgctgtgctttgtgcccggtaaacgcggtagcgtactgacgctgatgatggcgcagacgctttttattgtcatgctgtggggagtcggcagggcggcgacccagttggcgcaggagggcagtccgctggcgcgtaccagtctgggaagtggattgtggctgggcctcggtctgatgctgctggcctgtagcgatgcgatccgccgtattaccgttgggccgctgtggcgctggttgctgcacgcgcaaattgtcattgtcccgctggcgctgctgttttcaggcacgttcgacaacctctcgcttctgaaagagtataccaaccgccaggatgttttcgatgccgcgctggtgcaacatttaatgttactggcgggcacggtgctgccggcgctggcgatcggactaccgttgggcgtctggtgttatttttccgcctcacgccaggggccggtgtttaccgtactgaatgtgatccagactattccttccgtcgcgctgtttggcctgctgatcgcgccgttggccgggctggtgaaacagtttccgtggcttgccgaattcggcgtcgcgggaaccggcatgacgcctgcgctgatagcgctggtgctctatgcgttattgccgctggtgcgcggcgtggtcgccgggctcaatcaggtgccacgcgatgtgctggagagcgcaagagcaatgggaatgagtagcggccagcgcttcaggcatgtgcaactgccgctggcgctgccggtctttttacgtagcctgcgggtagtaatggtccagacagtgggaatggccgtcgccgccgcgctgattggcgcgggaggtttcggcgcgctggtgtttcaggggctattgagcagcgccattgatttagtcctgttgggcgtcattccggtgattgcgctggcggtagtgatcgacgcgctgtttgatttatggatcgcgtttttgaagggagcaaccgatgattgaatttaaccatgtcagtaaaaccttcggcgatcaacaggctgttagcgacctcaatttgcactttagcgaaggcagcttttcggtgttaattggcacctccggttcgggaaaatcgaccactctgaagatgattaaccggctggtagagcatgatagcggaacgatccgttttgccggtgaagagatccgcagcctgccggtgcttgaactgcgccgtcgcatgggctatgccattcagtctatcggcctttttccccactggacggtggcgcaaaatatcgccaccgtaccgcaactacaaaagtggtcgcgtgcgcggattaacgatcgtattgatgaactgatggcattattgggtctggaaagcgcgctgcgcgatcgctatccgcatcagctttccggcgggcaacagcagcgggtcggcgttgcgcgggcgctggctgccgatccgcaggtattgctgatggacgagcctttcggcgcgcttgatccggtaacgcgcggcgcattgcagcaggagatgacccgcattcatcagctactggggcgcaccatcgtactggtgacgcacgacatcgacgaggcgctacgcctcgccgaccatctggtgctgatggacgggggccacgttatccaacagggatcgccactttctatgctgacctcgccggaaaatgatttcgtgcaggcattttttggccgcagcgagctgggcgtaaggctgctttcgttacgtagcgtaggcgattatgtacgtcggcatgaacagctcagcggcgacgcgctggtggaagagatgacgctacgcgatgcgctatcgatgtttgtcgcccgtcggtgcgacgtcctgccggtggcgaatcagcagggcgagccctgcggtacgctccatttccgcgatctgctttcggagacgtccccccgtgaaacgactgtgtgatccgcttctctggcttattgttctgttcttgcttctgctgtttggattgccttatagccagccgttcttcgccgcgctgtttcccgatttaccgcgcccggtctaccaacaggagagttttgccgccctcgcgctcgcccatttctggttggtgggcatctcaagtttgtttgccgtcgtggtgggcgtcggcgcagggattgcggtcacgcgagaaagtgggaaagagtttcgtcccctagtggagactatcgccgccgtcgggcagacctttccgccggtcgcggtactggcgatcgcggtacccgtcatgggttttggtcagcaaccggccattatcgccttgatcctgtatggggtgttgcccatcctgcaggcgaccctggccgggctgggcgcggtgcctgccagcgtgatgagcgttgccagcggtatgggaatgagccgtcgccaacagttgtatcaggttgagctgccgctggccgcgccggtgattctggcgggcatccgaacctcggtgattatcaatattggtacggcgaccatcgcttcaacggtgggggccagtacgttaggcacgccgatcattatcgggcttagcggctttaatacggcctatgttatccagggggcgctgctggtggcgctggcggcgatcattatcgatcgcctgtttgaaaggctgacgcgcgcgcttacccggcacgcaaaataaaactgtaacctgccagcatcacgccgccgataccgccaatagccatcagcaggaaaagggcgatcaccccgattttcgctacgcgcattatgtactccttatgttaataaaaggagtatacattaaagcgaatttgttagctgctgtttaaacgccaaggggatgaatgtcgtgtccctgggcgcgccatgccaggagttgctgctgctgcgccagcgtctggtgttctccgcaccataccagtaacgtcttgccgtcaaaaagttccgggcggaactggctaagcgaatgcgccaacacgtcgattcgccatccctgttggctggcgacccaaccttccagccacaggcgggtggtatcatggatattccagccgatcaccaacgcatcttttccctgtttcttacgcgcagacgccaggcagagcgcaatatagttgatcaggataccgtcaagaatgccgagcagcgcctgaagggcgggttgttggcactgtaatcgtcgccgcagtgggacgaacaggttagtggtcaatgtttgggcaggataatcctgaccgcgttctttgacccataaccgtaaactgtgcagattactgctttgcaggtagtgcagcaggatctcctgctgttcgcgccagccgttaggttgttcgctactgtcgctactgagcagcactttgactttgctgacctggacgccgttatctatccagcgcttgatttcgcggattctgtcgatatcggcatcgttaaacagacgatgaccgccatccgttcgctgtggttttaaaagtccataacgtctctgccacgcgcgcaacgtgacaggattgatatcacaaagcaaagccacttcaccaattgtgtaaagcgccatcgtttcacccttgctcgcgaggtcccggtttaactttagacgctcttttaggaaccaggaagttttgcctgttttttatgcattaaaacgcgaagtagcgggttgcggcgcggcgtttaagtgatcgtattcacgaattcatatttttatgcaacagttcaaagaaagttaatcgtactcaatgtatgttacgcgcttttaattgaagtgtggtttgcgggtatgtacgagtttaatctggtgttgctgctgcttcagcagatgtgcgtgtttctggtcattgcgtggctaatgagtaaaacgcgcctgttcatcccgcttatgcaggtcacggttcgtctgccgcacaagcttctgtgttatgtcacgttttctatcttctgcattatgggcacttattttgggctacatatcgaagattcgattgccaatacccgcgcgattggcgcggtgatgggcggcctactcggcgggccggtcgtcggcgggctggtcggtctgaccggtgggttacatcggtattctatgggcggcatgacggcgctgagctgtatgatttccaccatcgtcgaagggctgctgggcgggttggtacacagcgttctcatacgtcgcggacgcccggacaaagtgtttagcccgctgacggcgggagcaattacgtgtgttgccgaactggtgcagatgctgatcattttactgatagccaggccgtttgacgatgccctgcatctggtcagtaatattgccgcgccgatgatggtgacgaataccgttggcgccgcgctgtttatgcgtattttgctcgataagcgcgccatgttcgaaaaatatacttcggcattttctgttaccgcgctgaaggtcgccgcgtcaacggaggggattctgcgtcagggatttaacgaagtgaacagtatgaagatgacgcaggtgttatatcaggagctggatattggcgccgtcgccatcaccgatcgcgaaaaactgctggcttttactggtattggcgacgatcaccatctaccgggcaaacccatttcatcaggttatacgctgaaagcaattgaaaccggagaggtggtttatgccgatggcaacgaagtgccgtatcgctgttcgctacacccgcagtgtaaactcggctcgacgctggtgatcccgctgcgtggcgaaaatcagcgagtcatgggcaccattaaattgtacgaagcgaaaaaccgactgttcagctcaattaaccgtactctgggggagggtattgcgcagcttttatccgcgcagatcctggccgggcagtatgaacggcagaaggcgttgctgacgcagtcagagatcaagctgttgcacgcgcaggtgaatccgcattttctgtttaatgcgctcaataccattaaagcggtgattcgccgcgacagcgaacaggccagccaactggtgcagtacttgtcgaccttttttcgcaaaaatttaaaacgcccgtcggaaatcgtcacgctggcggatgaaattgaacacgtgaacgcttacctgcaaattgaaaaagcgcgttttcagtcgcgtctgcaggtacagcttgatgttccatcgacgctttcacgtcagaaattgcctgcgtttacattacagccgattgttgagaacgccattaaacatggcacgtcgcaactgcttgataccggcaacgtcgctattcgcgcccggcgcgaagggcagcatttgatgttagatattgaagataatgcgggactgtatcagccttccgccggcagtagcgggctggggatgagtctggtggataaacgtctgcgcgaacactttggcgatgattatggtattagcgtggcctgcgagccggactgttttacccgaattacattacgacttccactggaggaggacgcatgattaaagtgctgattgtggatgatgagccgttagcgcgggaaaatctgcggattttgctccaggggcaggatgacattgagattgtgggagagtgcgcgaacgcggtagaagcgattggcgcggtacataagttgcgacctgatgtgctgtttctggatattcagatgccgcgtatcagtggactggagatagtaggaatgcttgatccggaacaccgcccgtatatcgtttttttaaccgcgtttgacgaatacgccatcaaagcctttgaagaacacgcttttgattatctgctcaagccgatagaggagaaacggctggaaaaaacgttacatcgtctgcgtcaggagcgcagtaaacaggatgtttcgttgttgccggaaaactcgcaggcgcttaaattcattccctgtaccggacacagccggatctatttgttgcaaatggatgatgtcgcctttgtcagtagccgtatgagcggcgtttatgtgaccagcagtgaagggaaagaggggtttaccgagctgacgctgcgcacgctggaaagccggacgccgctactgcgttgtcatcgtcagtttctggtgaatatggcccatttgcaggaaattcggctggaggataatgggcaggcagagctgattttacgcaacggcctgacggtgccggtaagccgtcgctatctgaaaagtttaaaagaggcgattggcctgtaaaagactgttagaatatcgttttgccatagaaacgaccgaaggcctcatgctgagtaacgatattctgcgtagcgtgcgctacattttaaaagctaataataccgatctggtgcgtatcctggcgctgggtaacgttgatgctacgccggagcagatagcaatctggttgcgcaaagaagaggaagaggggtttcagcgttgcccggatatcgtgttgtcctcatttctcaatggcctcatttatgaaaaacgcggcaaagatgaggcggcgcctgcattgacggcggaacgtcgtatcaacaacaatattgtgctgaaaaagctgcgtattgccttttcgctaaaaacagatgatatcctggcgatacttaccggtcagttgtttcgtgtctcaatgccagagatcaccgcgatgatgcgcgcgccggaccataagaacttccgcgaatgcggcgatcagtttatgcgttattttctgcgcggtctggcggcccgtgaacacgcggcgaagtaattctgcggtattgttcccggcagcgtcctgtctgaccgggaaaacgcattattatactaattgattctatgatacccgctctcttccaacagtttctgcgagcgaatcattgacagatagtacgcggaacagttgtcaattgatgatcctggcaatttacagaggtcgcttatttttgcctgggtaaaatcaatatccacatattccgtagcatagctatcataatagtcgattcgttcagtcaaacccggcataccctgataagcttcgccgacttgactcagcattttttgtgcttcttctttattattggctttcagggtcttataaagtagtttatgttcagatatttgacgtaaaacgatatcccctttgtagtaataggttaacttgatttcaataccgttgagattacctacatagcgttgtgtttcctctgactctttgctagcggctatcttcttgataaacgctgtcatgttattttgctttccctggagagtatcgtttttctgatcgcagccagttatgctaaccgatagagagagcgcgaatagtggcagtgccataagacgtagaacctgcataacaattccttgtcgttaagtattggtgtggccaggaattcagggattataggctttggcgaggggacttacagcgaggctgtcttttttcggaattcataaagaaaagacgctgccgaagcagcgccctgagcgactttaccagtcgatgcaatacattatgcctgccagttatttcgcttctttaaaaccagcagcttccagcagcgtctgggtttgtttcatgctgatacctttgctggtatcgccggacaccatcgtccctgagatttgctgtaacgctttaaagtccactttttccatatccacagagacgttttcctgggcataggtatcttcataggttaatttttcttccactccggcgatatttttatatttcgcgctcagcggatcgagaattttggcggcatcttctttcgttttagcgcctacagtggcatagctgattttactttcagacgtctgcttaatgattttgtcacctttataggtgtaagtaattgaaatttctgtccccgccaggtttgcgttaaaggtctttgattcttctttatcgccacagccagcaagagagaacaccagtacggaagccaaagccgcggacaataacttgccagaaattttcatctaaaactccattttatataatgattgggtttttaaaataatttcaatgaattaatttaacccagtaatagcaatgtatcagggagagatagaatatgacttttagccgttatttagcagtccggatatggagtcttaacgctattgcttattaaggaaaaagttaaaacacgcggatggggtgatatgccagtcaggattaagcggttaaaaaagccggagcatgctccggcttgttgcttatttcacctgttggccaggcttcgcgccgtcattagggcttaacaggaagatatctttcccgccaggtcctgcggccatcaccattccctcggagacgccaaagcgcattttgcgcggcgcgaggttggcgaccattaccgtctggcggccgatcagcgcctgcgggtccgggtaggcggaacgaatgccggagaagacgttacgcttctcgccgcccagatccagcgtcagacgcagcaatttgtcagaaccatctacgaactcagcgttttcaatcaatgctacgcgcaggtcaattttggcgaaatcgtcaaaggtgatggtttcctgaatcgggaagtcggctaacgggccggtaaccggcgcggctgcggctttcacctcttctttagacgcttcaaccagcgcttcaacttgcttcatgtcgatgcgattgtagagcgccttaaaggtgttgaccttgtgactgagcagcggctgttcgatggcatcccagttcagttcgctgttcaggaaggcttcaacgcgttcagaaagcgtcggcagtaccggtttcagatacgtcatcagcacgcggaacaggttgatgcccatcgagcaaatggcctgcaggtcagcgtcgcggccttcctgtttagccaccacccacggcgcttgctcgtcaacataacggttagcgacgtcggccagcgccataatctcacggatagctttaccgaattcacggctttcccatgcttcgccaatcaccgcagcggcgtcagtaaaggttttgtacaattgcggatcggccagttcagccgccagcacgccgtcgaaacgcttattgataaaaccggcgttacgggatgccaggttgactactttattgacgatatcggcattgacgcgctggacaaagtcttccaggttcaggtcgatgtcatcaatgcgtgaagaaagcttcgcggtgtagtagtagcgcaggctgtcggcgtcaaagtgtttcagccaggtgctggccttaataaaggtgccgcgagacttagacatcttcgcgccgttcaccgtcacgtaaccgtgaacgaacaggttggtcggcttacggaagtggctgccttccagcatggcaggccagaacaggctgtggaaatagacgatgtctttgccgataaagtgatacagctcggcgtcggagtcttttttccagtactcatcaaaactggtcgtgtcaccgcgcttatcgcacagatttttgaaggagcccatatagccaatcggcgcgtccagccagacgtagaaatatttgcccggcgcgttcgggatttcgaaaccaaaatacggcgcgtcgcgggaaatgtcccactgctggaggccggattcaaaccactcctgcattttgttcgccacctgctcctgcagcgcgccgctgcgggtccacgcctgcaacatttcgctgaatgacggcaggtcaaagaaaaagtgctcggagtcacgcattaccggcgtcgcgccggacaccacggatttcggctcgataagttcggtcgggctgtaagttgcgccgcagacttcacagttatcgccgtactggtccgcggatttacatttcgggcaggtgcctttcacaaatcgatccggcaggaacatgcctttttccggatcgtagagttgagagatggtgcggttcttaataaaaccgttctctttcaggcgcgtataaatcagctcggacagctcgcgattctcgtcgctgtgcgttgagtggtagttgtcgtagctaatattaaaaccggcgaaatcggtctggtgctcctggctcatttcaccgatcatttgctccggtgtaataccaagctgctgcgctttcagcatgatcggcgtgccatgagcgtcatcggcacagatgaagttaacctcatggccgcgcattcgctggtaacggacccagacatcagcctggatgtgctccagcatatggccgaggtggatagagccgttggcgtacggcagcgcgcacgttaccagaattttcttcgcgacttgagtcatagtgggtattacttcttctgttgtaaaaaagggctttgatagtaccaaaatggtaattactgcgccaatcgataagggcatttatccgtaaatgaataattgttaccgctggagtaaactacaaagttacaatcgtacttttcagaactacaaaaggagtcgggatgaacgaacaatcccaggccaaatcaccagataccctgcgagcgatggtcgccgggacgctggcgaattttcagcacccaaccctgaagcataacctcaccacgcttaaggcgttgcaccacgtcgcctggatggatgatacgctgcacgttgagctggtcatgccgttcgtctggaacagcgcgtttgaggtattaaaagagcaatgcagcgccgatctgttacgtattacgggcgcaaaagcgatcgactggaaactgtcgtacaacattgcgacgctgaaacgcgtcaaaaatcagcctggcattaatggcgtgaaaaacatcattgccgtgagctccggtaaaggcggggtgggtaaatcgtccacggcggtaaacctggcgctggcgttagaggctgaaggcgcaaaggtcggggttctcgatgccgatatttacggtccgtcgatcccaaccatgcttggcgcagaagatcagcgcccgacatcgccagacggtacgcatatggcgccgattatgtctcacggcctggcgaccaactcgatcggctatctggtgactgacgataacgcgatggtatggcgcggcccaatggccagtaaggcgctgatgcagatgttgcaggagacgctgtggccggatctggattatctggtactggatatgccgccgggaaccggggatattcagctaacgctggcgcagaacattcctgttaccggcgcggtggtggtgactacgccgcaggatatcgcgctaatcgacgccaaaaaaggtatcgtgatgttcgagaaggtggaagtgccggtgctcggcattgtggaaaatatgagtatgcatatttgtagcaactgcggccatcacgaaccgatcttcggcacgggcggcgcgcagaagctggcggaaaaataccatactcagcttctgggtcagatgccgctgcatattagtctgcgtgaagatctcgatcgcggtacgccgacggtggttagccgtccggagagcgagtttaccgcgatctatcgcgaactggccgatcgcgttgcggcacagctttactggcagggtgaagtgattccgggagaaatcgccttccgcgcggtgtaatcctcctgacgtattccaaagagaatatgacattcactgcattaatatatattgatgcagtgaatgtattaataaaataatagcccccgcattgttaattcctgcttaaacagacaggtgtttatctgaaataatcggcaaaaacattatttgaattgatcatacctatcctactgatttattttttcaattggttttaaggtatcgatacgttcatactgctcatcaggacggcctgcatactgtttgacgttcaccagaggaacaattactcactatgaaaaaatatttgctgatgggaattatagtttcggcttatgggataagcgtacctgtttttgcctccgacaccgcaacattaaccatcagtggaaaagtgaccgcgccaacgtgcagtacagaagtggtaaacgcacagttgcagcagcgttgcggcaacactatccacgtttcaactctgcaaacacccgccgctacgccgatgagaggtgtgacaacgcagctatacacggtgcctggtgatagcacccgacagattgttgttaatcattacgactaattcttattaattccgcaggcccatatcattgatatcaatgatatgggcttttttatttgttgtgtttatgtttaagggcagtaaatttcggaaattaataagtttacaaaataatgataagcaatgattatttgttgcaattatattgcaatctgtaaattgttttaaatcaacaaaacatcgtgtttacattgcgataacttcctgtctatgagaattttcgttgcaagggttaataactcttaacaaatagaaattacttcattaaggaagagattatgaaacgttcacttattgctgcttctgtattgtctgctgtatttatgagcgctggggcttttgctgttgatgagtatgattcaggcgttctgaatattaacggaaaggtggttggtactacctgtcaatttttgggtacgaacaccgctgaaattagactgaatgaaattggtgcggataaaataattaatttaaccccgggtcagatttatgacgcagtaactaatcaaactcagatgccgttgaaaataaaatgtcaacagggtgtagcgccgcgtattaccttctcttcaacgcaatttgacagccacgatatcacatttaataacgggtctgccaaaggtgtcggttttgcggtttactacggaagtacggataatcagattgatccagagacgggggtgacactagatccaaatagcagcggtgaatacgacctgacttttttagcacgctatgcgcgtttagacggtgatgttgcttctggtgatgttagctcaacactgactttaacggttgttactgactaatttattcaaccggcggcgttcgtcgccggttttttataagcaaggccgtgtaaatatgaaaatattatctgcagtattattatctgccataattttgcctgcgcatgctggtattgttatttatggtacgcgtgtgatttacccggcagagaagaaagaagtcgttgtacaattggtgaatcagggcgagcaagcttcgctggtacagtcctggattgatgacggtaacacttcattaccgccagaaaaaattcaggtgccatttatgctgacgccgccagtggcgcgcgttgccgctgagtctggtcagcagatcaaaatcaagaaaatgcctaatagcttaccggacaacaaagaaagtctgttttatctgaatgtgcttgatattccaccaaacagccaagaaaacgccggtaaaaatgtgcttaaattcgcaatgcagaatcgaataaaattaatatggcgccccagtcgaattgccgccgtaaccaaagacagttttcagaggattggtttatttcgcagtaataaaactgtcatcatgaaaaatgatactgcaaactggattaccgtgacggatgtaaaagcaggaaatactaagattaatgatcaaactatcatgctgccaccgctatcgacgcaaaatattaacatgaaatatgcgtcaacaagccagtatgaagtaacgattattgatgataatggtaactatattagtagcaaaattaatgtaaaataaacaggagttcatcatgctaaggatgacgcccatcgcttcgcttgttttattgactctgtttacctggcaaacgcaggctatcgcgacggaaacgtttgatactcattttatggtgggggaatgagagatcaaaaaataacaaatttccatctggatgagaataagccaattccgggacagtacgaattggatatttatgtcaacaatcaatggcgaggtaaatacgatatcattgttgccgatgatcccggtagcacgtgtatttcaactgagttgttgaaaaatattggtgtgataagcgatggtctgcaaccgcagggagcaacggattgtattgcgttaaaagatgtcgtgagaagcggtggctatacttttaatattggcgtttttcggctggatttgagcgttccccaggcctatgtaaatgaggtcgaggcgggttatgtattgcctgaaaactgggatcgcggcatcaatgcattttatacttcttactatgccagccagtattacagtgactataagaattctggcagtagtgaaagtacttacgttcggttcaatagcggtttcaatctgttgggctggcaagcgcatgcggataccacatttaataaaaccgatggcagcagcggtgagtggaaaagcaacacattgtatctggagcgcggtatcgctgagctcctcggcacattacgcgccggggatcagtatacctcgtcagagatttttgattctgtgagatttaccggcgttcgcctgttccgcgatatgcaaatgttgccaaactcgaaacagaattttacgccgttggtgcaggggattgcacagactaacgctttggtaaccatcgaacagaacggattcgttgtttatcagaaagaggttcctcctggccccttttccattgcggatctgcaactcgcgggcggtggcgcggatcttgatgtcaccgtgcgtgaggcggatggttcgataaatacctggctggtgccttacgcttccgtaccgaacatgttgcagcctggcgtctctaagtatgatttttccgccggccgtagtcatattgaaggcgccgataatcaggccgattttacacaaatcagttatcagtatggccttaataacctgttgacgctttatggcggtacgatgctatcgaaccattataatgcgtttaccctcggcacggggtggaatacccggattggcgccatttcgcttgacgctacgcgagcgcacagtaaacaggataatggcgatgtatttgatggtcagagttatcagattgcttataataaatacctgacccaaacattaactcggtttggtctggctgcgtatcggtattcatcacaggattaccgcacatttaacgatcatgtctgggccaataataaaaataactatcgtcgcgataagaatgatgtatacgatattgctgattattatcaaaacgattttgggcgtaaaaatacgttttcagctaatgtgagccaatccttgccagaaggatggggcgcagtatcactgagtgcattatggcgtgattactggggacgtagcggcaccagtaaagattatcaaataagctattccaatacgttccagaaaattaattatacgttatccgccagtcagacttacgacgaggatcataatgaagataaacgttttaacctgtttatttcaattccctttgactggggggacggtattactaccccgcggcgtcatctgaatgtgtcgaactcgacgacctttgatgatgatggatttacctcaaacaatattggtttaaccggtacggcaggcagtcgcgatcaatttaattacggcgtgaatgttagtcatcagcgacacgatagtgagaccacagcggggacgaatttaacctggaatacgcccgttgcaacgcttaatggtagttacagccagtcgtccaattatactcagaccggcggaagtatttccggtggggttgtagcctggagtggcgggttgaatttatccagccggctttcagatacctttgcgattatgcaggctccgggacttgaaggagcctacgttaacggccaaaaatatcggaccaccaataaaaaaggaacggtggtttatgacaaccttacgccatatcgcgaaaaccatcttatgcttgatgtgtcgcaaagtagcagtgaaacggaattacgcggtaaccgtaaagttgccgccccgtaccgaggggccgtcgtgctagtgaattttgataccgaccagcgtaaaccatggtttattaaagcgcagcgtcctgatggctcgcctcttatttttggttatgatgtagtagatcatcatggtcataatgtgggcattgttggacaaggtagtcagctatttattcgaacgaatgatattccgcccgaagtcagtgtaccagtagataaagagcaggggctttcatgttcaatcacctttggaaaaacggttgatgaaagtaaagtttatatttgtcggtagtggtgaggtggtgaaatgaaactctttctttttatcgtgatgttattgattttacctgaaacatacgcagcctgtacgggagaaattacttatcaggataatttaattattcgtgaggattttacgattaaccctaatcagtccgcaacttatagccataattttaacgatacaacttgttcagggacttataagataacgcgtatggatccttccgatatcatcgtgggattatacaatgatacagtaaaactgaagttaaaaatcgcctgggcagataataatactctcacaatgccgtttacaacgggctatacggtaacggttgaacccgcttcctctggggcgaatgtaaatatttctgccggtagtgggaacagtgtcctaatcaacggggtggtatcaataacaagcgcttcttctgcaactcagtttacggccagtttgcggtttttagggtgcctgctagcaggaagaggctggaatgcctgtgccgcagattataatagttatcttagaggtgcagggttatattcatttgatctgtttgtgtcctacgatcgcaagcagacaacctgcaaacctgaagatctgacgatcacgctaccgaatattgcgctttctgaattatataacacaggcaaggtcagcaacaaaaatgccgcggataatattcgactccagtgtgataatctttttggtaatgctaaacaaacatcgcgtaaaatgacggtttatctctccagcagtgatttaataccagatagctattctgtgttgcgtggtgctgtgaataatggcgtcggatttatactggagagcggtggaaaaacggtgaatatttcaaatacagcagagcagggtaatgcttcaacgttatggaaagtggatcaagtaggcacgccgctcaacagtgatatgataacaatccctattatcgccagttattatgtttatgaccgagacaatataaagccaggcgatctaaaagcgactgcgctgatctatgtgaaatacgattaatatatatgaaaaacatttaagatatatggcgcgataggtgaatgaacttccggtcacttacaataataagtgaccgggatgacaatctttctgcaataaattctaatgtggtatgcggtagtttcaaaagggcgagatccagagcgaatcgggtagtgaaggcagtcaacaaaaaggaggtttgaaggggatagagtgattaagggctaataaaaaagtaacatggggctgtatttccccctctggatgagggggctttttttatcgatgataaaaaatctcgccatcataggctttgatgatttttccatcggtatcgttaatcagtacatacgcgccgcccatataggtccagtgagtaccggcatctggcgcgggcagattacgtaatttccactgtttaatattatactcatcggtgcggtacatttgcggaacggtatcgccgggcttgaagtgggtgaagtcggcgataaagctttttaactcatattgatcaatgcccgttgtcgcgggggcggcccatgcaaaactggttgcaagcaacagcgcgcaaggcagcaacttacttttcatacttttaccctccacatatgcgggtcagttaacatcgtgtgtatcatttctgctggtggcgtatctgacaagcgctattttgttatctcacgccccttttcgtaaaaagtgtaaacgaaagcgtcgtgcagcaacatatccgccagcaagtttgccagaaccgaataggttttgagaactatctgataacgctaaaattatcgtccgccgctgactgtaaatttacattgtctggcacagacagtatgcttaatagcgaaaccccgcttaacacggtggggcttgacgactcggggtgcccttctttgtgaaggctgagaaatacccgtaccacctgatctggataatgccagcgtagggaagtctgacactgctcgtgtcccttcttcacgcgggcaggagctgaaccatgcagcctgacctgcactgccgcacgcttgcggcgcatacgttaaaacactttcgcgcgctctccccgcttacgcactgtatgacgaatgacgtcgtacaaacgtttaccgccaatacgttgctggcgctgggcgcttcacccgccatggtgattgatcctgtcgaggccagaccgtttgccgccatcgccaacgccttgctgattaatgtcggaacattaactgcctcacgcgctgacgcgatgcgtgcggcggtagaaagcgcttatgatgccaaaacgccgtggacgcttgatcctgtcgcggtgggcgcgctggaatttcgtcggcgattttgcctggatctcttgtccctgcgcccggcggcaatacgcggcaacgcctcggaaatcctggcgttatccggcatggcgctgggcggacgcggcgtagataccaccgaggcggcgttggccgcactgcctgcggcgcaggcgctggcgcgtcagatagactgcatcgttgtggttaccggagagatagattacgtcactaatggtcagcgcacgctgagcattcccggcggcgatccgttaatgactcgcattgtaggcaccggctgcgcgttgtcggcggttgtcgccgccagttgcgcgttaccgggcgccgcgctggacaatgtcgcgtcggcctgctgctggatgaaactggctggacaggtcgcggcagagcgtagcgaaggaccgggcagcttcatcccggcttttcttgatgcgctctatcatctggatatggaggcggccaatgcaacgaattaacgcgctgacgattgccggcaccgatcccagcggcggggccggtatccaggcggatctcaagaccttttccgcgctgggcgcatatggctgttcggtcatcaccgcgctggtggcgcaaaatacctgtggcgtacagtcggtgtaccggatagagccggactttgtcgccgctcaacttgattccgtgttcagcgatgtgcgcattgataccacaaaaatcgggatgctggcggaaaccgatattgtcgaggccgtggcggagcgactacagcgtcatcatgtacgtaatgtggtgctggatacggtgatgctggcgaaaagcggcgatccgctgctctcgccctctgcgatagaaacattacgcgtccggctgttgccacaggtatcgctgattacgcctaatttgccggaagccgcagcgttgctggatgcgccccatgcacgtacggaacaggagatgctggcgcaggggcgggcgttactggcgatggggtgtgaagcggtattgatgaaaggcgggcatttagaggatgcgcaaagcccggactggctctttacccgtgagggcgagcaacgttttagcgcgccgcgtgtgaacaccaaaaatacgcatgggacgggctgtacgctgtcggcggcgctggcggcgttacggccccggcatcgctgttggggagagacggtaaacgaggcgaaggcatggctttcggcggcgctggcgcaggcggacacgctggaagtggggaagggcattggtccggtacatcatttccacgcgtggtggtagtatactgcctacagacccgtcgtcaggaaagataaatggaacaagcgcatacccggctcatcgcgcaactgaatgaacgaatttcagcggcggataatacgccgctatacatgaaattcgcccagacggtaaaggatgccgtgcgcagcggtattcttgagcacggtaatattttgcctggcgaacgcgatctcagccagcttaccggcgtctcgcgcatcacggtacgaaaagcgatgcaggcgctggaagaagagggggtcgtcacgcgcgcccgcggctacggtacgcaaatcaataatatctttgaatattccctgaaagaggcgcggggattttctcagcaggttgtcttgcgcggcaaaaaaccggatacgctatgggttaacaaacgcgtggtaagttgtccggatgaggtcgcgcagcatctggcgatccccgcaggcagcgacgtctttttactcaaacgcattcgttatgttgatgaggacgcggtatcgattgaagagtcctgggtgcccgcgcatctgattcatgatgtcgacgcgattggcatttcgctgtatgactattttcgtcgccagcacatttaccctcagcgtacccgatcccgcgtcagcgcccggatgccggatgatgagtttcagtcgcatattcaaatggatggtaaagtgccggtgctggtgattaagcaggtggcgctcgatcagcagcagcggcctattgaatacagcatcagttattgtcgtagcgacctatacgtttttgtgtgcgaggagtagcgcctcgcgcgtgggcgcgcagtcgccgccgcgatgcccgaccacccagctcgccaccgcatttcccagcagtacggcatccgcgagcgaccagcctgacgccagtcctgccagcacgccgccagcatggctgtcgcctgcgccgatggtatccaccacggttgccggaaacgctggcacaacgccggaagattgcgcgctaaaataccacgctccgtctttatcgtggcgcaccaccagcggcgcggaaaagcgttttacccatgcttcgccgaaagtgcgggtatcggtcgcaagcccggcgcgttccgcggcgatgatggcttcctggcgattgagggatacgatgggccggcaggccataatgcgcgccattgcatcgtctgtaatatcaccgattcgcgggccaaaatcgataaaaggcgttacatcgtcgacggtttccagccactggatcagtggctcgccacaggacgaggccagttgatagccggacaggtagacaagactgccccgcggtgtcctgagctgcgacagccagtccgcattccactggttttccacgccgctaaaagacataaacgtgcgttcgccatccggttcgactaacgccagacaccagccgttatctccttcaaccgcgtcaatcacgctggataatccctcttttgccagacggcggcgaatcctctccgcccacacgccctggcccagcggcagcgcattgctggcgtcaatccccagtcgtttcaacgccacggcaatattcagcgcacagccgccgacattgacgctctgttgttgcagttcaatatcgcctccgcgacgcggcaacgtccaggcgtcggcaatgatatcgatcactgccgcgccgataacggtgagcggacgccgggtatgcagggtcggtaataatgtcagcaaccgtgcgccgttcatagtgcctcccgccgttgacgatagctcgccagcgcaacggcatagcgcgcaaaatccagctgattaaccttgtccagcgtttgctttaactgggggttaatggcgcttaccccgtgcaacgcgccgcaaatggcggtagccatcgcgccgatagtgtcggtatcgccgccgaggttagcgcacagcacggcacagcggttaggatcggtattcgccagctccaccatggcgatagcgcagggaaccgattcaatggtgctggttcccgcgccgatgatctgatagagctgttcgctggcagattcgacgccgtcggcgtggcggacaatgtttagcgccagttccagacgtgccgatagcgaggcgctaaacgtggtaatacgcgctgtctgcgcctgatgggcgatggcggggagcgagtcggcaatactttgccacgtgtcgccgttaaccgctcgcgagacggcccaggcgacaaccacggcgccagccaccgccagatcggatttatgcgtcgggctggaggctaacgctacttctgctataaaggctgtcaggttagttggcggcaacaggcagcccaacggcgaaacgcgcatggccgcgccgttagtcacgccgttattttccagcgccgcgatgggtttgccgtcgcgaatcgcattcagcgcaatttttgacgtcgggccgagtacatttttattgaacgcatcaaagcgttccgcccaggcgaggatgttacgcccaataatctcgggatcaatgttgccttcgcattcgagtagcgcgtcggccaggcagagcgccattgcggtatcgtccgtaaactccgcgcggttaaaatagcaggcggcattattttcttttgggccgggcagaaagcggtcaatccagccgaaatgcgctttgacgcgcgttctcggccacagctcagagggcattcccatcgcatcccctaacgcttgcccgtaaagagcaccgagaatacgttctgctttcattttacttccccttgtgtcaacgcaatatcgcgatcgtcaatagcagtgatctctttgtccgattcgcgaaagaaaatcataaacagtagcgcgatgacggcaatcatcactgcgccaaacgtccacatgcccgcccagttgaatgtcagaccgttaaccggttgcggataagcaaacatttttttcatcatcacgccgccgagacgatagcccagcaggctgccgaatccctgacagcagagggtgataagcccttgcgcagcggtacgcatatgaaccggcgcttttttatcgacataaatgtaggcggtgacgtagtagaaatcgtaacttacgccgtgcagcaaaataccgaggaacagcagggcgtaagtgaagtacgtctccgcgccgccatagacaaaaaagccgtagcggatcgcggcggtaataagaccaagtaataatacctttttaataccaaagcgcttagtgaaaaagggtagcgccagcataaagaagatttcagagaactggccgagcgtcatccagccggtggcgtttttcattcccacttctgtcagatagccgttagcgaagatgtagtagaaggccagcggcatcgcaaacaggaaggaacagaagaagaaaacgagaaagtttttatcgcgcagcagaaccagcgcatccagccccagcatcactttaatatccatcttgccggtgctttttggcggcgtgtctggcagacagaacgcaaatacgcccagcaacgctgaacttgcggcggttatgagcagtggaatgttggtgggggaaatatcgttatagcctaacatttgcggcaagaatccacaggcgaggccggaggcaatccacccaatggttcccataacgcgaatgcgtggaaaatcgcgttcaacgtccggtacgttagcgaaggcaatgctgtttgtcagcgcgatggtcggcatataggtcaatgaataggccaggagcagcggaaagaatccggcaaaggtggtttgctgtgccgcgaaatacatcagtacggcacccgcaaacatcagtaccgccaggactttttgcgctgagaaaaaacggtcggtaacggagccgaccagaatcggcgacaggatcgccgcaatggcggtacaggcataagaccagcctatttcaccggcggaaaacccgcttttatttagccatagccacagggggacgaaccaggcgccccagataaaccactccacgaacatcatgaacgacagtttaaaggtcgttttcatttttgaatccttcatgacaggtaaggtacgccacgacaataccacttaataataccttttaaataccattgagcattaattttgaccgatctaacactttttcggacgtgaatcgagtcagcagatagcgccgaaaaaatgcgctaaagttggcaaaaatggtcggtcagtaccaggcttattgcgacccgcaatctgcggggcaggactattcaccttccgataccctatcggaacttacgggagcatagctatgactgatattgcgcagttgcttggcaaagacgccgacagccttttacagcatcgttgtatgaccattccttccgatcagctttatctacccggcaaggattacgttgaccgggtgatgattgacaataatcgtccaccagccgttctgcgtaatatgcagacgctctataatactggacgcctggcgggaacaggatacctttcgatactgcccgtcgatcagggagtggagcactccgccggcgcttcttttgcggccaacccgcgctactttgacccaaaaaatattgttgaattggcgattgaggccggctgtaactgcgtggcctctacctacggcgtactggcctcggtttcacggcgctatgcgcaccgtattccgtttttggtcaaactgaatcacaacgaaacattgagctatccgacagagtacgatcagaccctgtacgccagcgttgagcaggcgttcaatatgggcgccgtggcggtaggcgcgacgatctatttcggttcggaacagtcccgtcgccagattgaagagatctccgccgcttttgagcgtgcgcatgagctgggtatggtgaccgtattgtgggcttacctgcgtaattcttcctttaaaaaagacggcgtcgattaccatgtatccgctgacctgacggggcaagccaaccatctggccgctacgattggtgcggatattgtgaaacagaaaatggccgagaataatggcggttataaagcggtcaacttcggctataccgacgatcgcgtgtacagcaaactgaccagcgataacccgattgatttggttcgttaccagttggcgaactgctatatgggacgcgccgggcttatcaactccggcggcgcggacggcggtgacactgatctcggcgacgcggttcgtaccgcggtgatcaacaaacgagccggtggaatgggactaattctgggacgtaaagcctttaagaaatcgatggctgatggcgtgaagttgattaatgccgtacaggatgtctatctggatagcaaagtcaccatcgcctgagttcaacgaagaaaagccggatgtgagcgcatccggccagcgactggtgttattaacgtagcaacgggcagtctggcggcagccgacagcgtaatgcgccaggcagcacctcaatatgaaattcttgcccgctgagtggttcgccatccagattgaacgtgatttcatgcggtgcatgaatatcaaaccacgctgaggcgccgtcaataatattcggattgtcatctgactgcgtgagtgtggaaaacagcgccggcagcagttcttcgccggtaaaaatccgtagctgtaacagtccgtcgttaatcagcgcggtgggacataattgctgcccgccgccggcctgacgaccgttgccgatgccgatcaccagcgcatctccctgccagtgaaagttttcgccacgtatttcgcagcggtcaggggtcagcgtatccattctcatcagaccgtgaataagataggagacgccgcccaacgcggctttaagtttttccggcgtttcggtggtaatgcgggtgccaaaaccgcccgtcgccatattgataaaacaggttttatcattgaccctggccatatcaatttccatcgcgtttccggcaatcgccagtttcagcgctttgtccagcgcttcaggaataccggcgctggtggcaaaatcgttggcggtgccgagcggcaaaaggcccagtgcgggggctacgccgtcgcggatctggatgagcgcggtagacacttcattaatggtaccgtctccgccgccggcaatcaccgtttcaacgcccagtctacgggcttcatcaacgtaacgctgcgcgtcgcctttttcccaggttacccgaacgtgaatctgtatgccttcgtcgcgaagtagcgtaatggcctcacgtagcggctggttatcagcgcttttgccattgaggatcagtaagctggcgggaaagttagctatccgttatgccttaataggttgaacaacaatctccagaaagtgtatagcagaaatgaaaaagcgaggtcagaacaggatgaaaattgaaacgttgcgcacttattgctttaccgtttttcttcctgctgtacgcagcggtaagcgaagcatggtttaaggcaaatggcgacaagagagatgccggtatgcgcattgagtagcgcttgtgagagtgcaaggaaaccacaaggggtagccagacgctttccgatatagcgcctttaataacgaaacggaggattaacaagacgaacatacgtcagttatcagtattaatttcaaacaccacaatatcagataaaaacctgatatttattaccaaacatactttttaatagcataaaatcgaaatgttctttagactgctttggcaggaacaagacgcactattagcagtacactattcttgttatcaaataaaacctatttagatgatgacttagcgcagtgtcttatagtcgtaccgttgcctgaggtatcgcttttctcataaacataaacaggcatgtgcatgaagaggtttatatgaatgtcacttcaggcgtgaatgcgcaaacgccattgctccccccttctgaatggggtgatgacgaaaaaccggtagctgaaatcgttgagtttaacgcttacggcaataaacccagatgtttaatgtgcctgggaaccacggcattgtttacaggtgctttcagtggggtatgctcaggggctgtcgccagtgtcagtagtggtgctgcatatactaccgctctgacgattttaggcgcatcgtttggcatggggggaattggtatgatgggaatatgcgccggactataccttagcgcaaatggcgtcagaacccggccagcctggccataaatgagcaaacacagcaagtcatagggaaaagatgaattccggagatgacacggggtgttaagcgtccagaccagaggcttatgacttatatagaaacgctttagatagagtatggggtgttatgtattcaagagccgatcgcttattaagacagttttcactgaaattaaatgccgattcaattgcctttgacgaaaacagattatgctcatttattatagataaccgttaccgtatcttactaacaagcactaacagtgagtatataatgatatacggtttttgcggaagacctccggataataataatcttgcttttgaatttctcaattctaatttatggtttgcagagaataatggaccacatttgtgttatgataataactcacaatcattattactggctctaaatttctcactcaatgaaagttctgtagagaaacttgaatgtgaaattgaggtggttattagatcaatggagaatctgtatcacattttacaggataaaggaataaatctggataccgattatacgtgacggtgggaagggtgtttggtgatctggtggtaatagaggataatcaaccccagcaaaacttacatggcctgatgaagatggactgagcgtaggtgcgatggtttgagtattactttgacatgaaatcaaacctctaatccgggaaaacattattttaatccttgtaaaagcggcattaaaacgtgccataactttacacgcttaaattatcagtttttaaccttaatttaataacctggaaactttttgtgtaagtactcacaaagcagttattgatttaattcactgattttaaacgtaaacgtcagaatgctaagtcctgagtctgaccagatgcagggaggattgtgacttgctggctggccatgaataggggaggtctctaaacctaagcgcccatttgcgctttggttagtgtggtcaattttcggatgtggcgggaagtaccacttttttattgattatacgcaaaaaataagcctgcgtaagggagattacgcaggccaaggaggtggttcctggtacagctagcatttatgggttatgtttttcagcgcgttgaataatacccgcattgagcgaagcggtatgtgatcaatttctaagaatcttcccgccatgaaaaaataaccgcaattaactacttagcatgggggttacgcgttgattcgcctgagaaattacgcatcaatagtgcgtaatccagcgtaacgtcctgcgggacgggcatccagacggtatagccatcgccaggcgccaccggcatagcgtcgcctttggcgttctccatctgttccagagtgaaattgatatttccctgcggagtcatcagctccagactatcgccaacggagaatttattcttcaccgccacggccgccagttggcctttacgctcgccggtgaactcgccgacaaattgctggcgttcggaaacggagtacccgtactcgtaattctggtaatcgtcgtgcgtatggcgacgcaggaaaccttcggtatagccgcgatgagccagaccttccagcgtttccagcagcgtagggtcgaagggtttacccgcggcggcgtcgtcgatggccttacggtagacctgggcggtacgggcgcagtaataaaaggatttggtgcggccttcgattttcagcgagtggacgcccattttcgtcaggcgctccacgtgggcgatagcgcgcaaatcttttgagttcatgatataggtgccatgctcgtcttcgaacgcggtcatgtattcgcccggtctttgggcctcttctatcataaacactttatccgtcggcgcgccgataccgagcgtcggctcaacgttctgtaccggaatcggttcatgcttatgcacgatgttgccgacaacgtcttcttttccttcctgcacgttatattcccaacggcaggcattggtgcaggtgccctggttcggatcgcgtttattgatgtagccggaaagcaggcagcgaccggaataggccatgcatagcgcgccgtggacgaaaatttctatttccatatccggcacctgctggcgaatttcctcaatctcttccagcgacagctcgcgggagagaatcacgcgggtcagccccatctgctgccagaattttaccgtcgcccagtttacggcgttagcctgtaccgacaggtgaatcggcattgccgggaagtgctcgcgtaccagcataatcaaccctggatcggacatgatcagcgcatccgggcccatctcgacgacgggtttcaggtcacggataaaggttttgagcttggcgttatgcggggcgatgttcaccaccacgtagaatttttttccgagcgcgtgggcttcgttgatgccaagctgcaaattttcgtgattgaattcgttattgcgcacgcgtaaagagtaacgcggttggcccgcatagacggcatcggcaccgtaagcgaaagcgtaacgcatatttttcagcgttcccgctggcgaaaggagttctggtttaaacatcattttctcgttctgatgacaggtcagatccgcctcacctgatgaggcggctggaagagagtcctcactttaagggcgggcattgtacgcttacggacaggccgagtaaatattgcgagagtatattggcgctaatagaacaccggatgttaatggggagccaatgatgaaaatgagccgcacggccatcgcgctgagtttgctgggaatggccgcgcatcccgtttgtgccgctccgtcgtttgaagagacggcgagacaggtgattatcgcttttcagcagcgagacaacgcgaaaattaatgccctgattgataaaaaagtcgggatgtatgtgctgtaccgaattggggctgggtttgattataaatggatgaaaaaatttgatattaataaaccgatacctgactttaactacctgttggggcaggtaggttggttttcagagcatattcctgtggataaggaatttgatcaccacacggaggttgagtacgtttgtgaaaagggatgggatcacgccggtttttttgtcagctataccggttctgataatgcgctgctgacgtttagcatggtgaatggagcggatagtggggatcaggcgtcggatacccgtatagcaaacgccaggcggcttgagctgcaatcagagcgagtggtggcagtgccgaaagaatggggtgatggtttgatttttcatctgagcgagcttcatggcttgggcaaagggtggagtttaacgctgctggatttggtcacggaagattgtagtgcgtgaggcatatatgtttaatcagggtaaatggctgcttatttatatctttctgctatcaggatgttatggcaccccctcaatattcagaatttaaataaagcatttcctgaatatgaaactaattcactaaaaaataaaggtgaaatcacctcggcaacatgcattaaagaaaatacaaaaggtcatttgacttattatagcgtcagcgatcccgtctttaactaattcgggtcacgttatgtatccactatggggaatctttatatattccgaaaaaaaacacaatgatattcttaatgcagataagagagtaatcttagggtgtgcaggtttgtaaaccagggtatggcggtagcgttattttttaacgaggtatcatcagaggtagaattaacgatcgcagacgatactcagtactaagaggaaatcaggttgaggttgaacagaaaatgataaatacgtattgataagatggaatccattgaatctacttattagtagattttattatgaaaaatatatttttcttgatgttttttacgcattgcgcaatagcaaatccttgccgccttgatgcaacttgagtgattttgtgtatagtgtgacaatgctgaatactgaattgataccttctacatattaaatcagggggtagttgtatgggcgattttataaaatatctatttatttttccttgcttatggagcgcaaattcttttgcgattactcaaactcaatgggatggtaactttagagtcgaggaacttggcgagcagttaaatgataggagtcaggtttttttacaatataatttaaagatagatagtaaaaataatcgtgcttctttatccatgacaacttggcatgcggggataacatgcattggtgactactctttaaaaatcaattctggtgttttggtattatactataacggcgacgaggaaaatgcatgtccatatccatcaccgcaatttgagataagcaataaaggaaaagagtattatataaaaggaaaaatgttttcatattctcagcctggtgagtggttgccactcaaacgtattacactaaaataattctatattccataaattatgacgatgaagttaatgatggtataaaatattaaatggatatgtcgtgaacatatttttgttatatgttttcaatgtgtatgacaagaaaatttgcatgaaaacattatatgagacggtttgaaaaatgaatgaagttcacataaaagcaaggtcattctgaaacgaatttgtcaaatttgctgaattatatatcaataattactgagtatcgacaacaatgtaaaatcgagtacaaattcacggattctcttttgctgatggtttgtgcagtaattggtaggactgaaggttaggggagtatatgaagaaaacaatattgtcttttgttctgtgcttttttgtgaatttttgtcttgcagatatgcatattttaaagataaataaatcacactatatgcgctttttgccataaaaatgtgtaatagcacatcaattataaagaatagagaatatggcgggttagtctgtaaacctatagtaataaatgtattgcaactgaagctaagtagtgaagcttggttggtttttctccgtcaaatagctcttgtccttttggctcgactaaggttggtgattatcatacacatggcttttactctgatctaaaggggaatccagtattacctcaatatgaggcatatgactctttacatttttcaccgcaagatatttctgggattgcaagtgatggtataggtaatcctgattatactggctttttggggactccagataataaatattataagtttacccctggaactggaaaaaactgagggaatgaaatgaaatatattatttttgcatttatttttctaattccgttaagatgtatgagtgaaaaacttgtttttttagatgaagtacaaacaaaaactatgaatgttgctttttcacattttagagagcatacaaactggggcttatttaataccatgatacaggatgatgatgaaaatattaaaatcgcattctattgtaaatctcatctggaagaagcccgtggtggcggtatggagcaaattatttatataatttcaaaaaaagattttaaaattgaaaaaataaacaaaagttatagcaaatgaaatgatataaattgttgagtaattggtgaatattctctggtgttacccccgagcaaatggaacaagtacagcgagctattgactatggttcaacgaaaggtgtgactgtagtttttacaggagcaggaaaatgacatttatatttgatgtaaataaagagtatcacgcgggtgctaacctgacagataagtttttatgtttagaaacttattcgggattggggcgctattcttcagatcctgattacccttgtcagttattatctattgattcggatgatgtatgtatcggtcatgaattattacaagcattaaaaaatagcagaacttacaccccagaagagagtgaagagtatctttctttagagaaaacacaggtggagtatgatgagtgggtcactgtattgatggcaaaatataattatagaaccaggcgtgcattatttaaaaacatgaagtattgctcaattatatgcgtgaataatattattaagatacaacctactcgacatactaaacttgaagggtggagctgggccggacatgacaaagatgtaattagattgcctgttaccagcgaaccagagaaaattggaagtgcattgagacaggcatttgaatgttgtgattaatagcctgatgataggttatttatgtttgatagaaataagacaataaatttacaattgttgtaaggtctgattgatgttaaaaatagttatgctttttttgatgttttttccctgttattgcttacctatggatattaaaaatataaaagattgtaagttggaggaaggtaatagagttaaattaatttcattgagcactgttgatggtagtacgccatacttaatctttgacaatgttattgttagcgcatttcttgatggtagtatctattctggggacattatcctctcaaaatatatccatcactccctcatttttgcgctgaattacggcgctccttatatgaaaggctgtttgataacgggtttgagtgccagtgctgagagaagctataaacccaatggcttttgttttgcagaaagaaatattccagagtctgtctggtttggtgaagatcatacgttaattattattaaaaataataatagtgttggggaatggcgtggtaattatattatctatgatagccgtggagatgaggctcaaacatttaataaattgcctgacactaaaaattataaaatttatcgattagatttatattattgttcatgctatgttttctgggaggatcgtcaggttatgcgaattcagaaaagaacatttctaaagaacttcttagtgagtataaaaatttttcacttgctgagtgtattgaaaaaaattatgaaaaaatgggcgttgtttttactaagctacctttaaaagataatacaagaggatttatcgatttggatatggggcttgctttttatcgggataaagataatgttttagcttcatttatagaaaataaaacgggtgatttttataagcccaggcaggcttatggtgatttggcatcggtaaacatggttatatatgactgtatcgatttttatcattcaaaagaattgaatatatttttacgtaaaataatttctgaaagaaacattagaaatgagaatgattaacttaaataaaatgtttaattaagtctcaaatctattctatttcacccgaaatgaataagatatatcagatgtataaaaagatagtaatattagtgattacgcttattattatatttttcggcggtgggtggtatatgcataaatcacaacaacaaatggcaacccttgttatttctgatagtgaaaatgccctcgattatccgaataaacgtaaatggtttgatgccagtagatggctcagcacatcacaatatattaaaatagatgatttttatcttttaaatcttaagcatcatccagttaacaatataaatgatgcagggattattgtaatattacactttgcaattcgggatgcgataaagaaatttccagagttatcaaaattaagccagatggataataaggaattttttcatttcatgcagaataaactttctaacgagtatcttagaaccaaattcaatgaagatacactggaacctactgatgactattttttgttcttttttacttataatgaaatatcttatgaggtggaattattacggaaagttactgagcatggtatgatgtttgtgccttatggatatcaagttaataaaaaaggggattggcacagaatgcatccatctacatattcttgttttaacgatatccaaagtaattagtgagacgttacgaaagctttttaacaccatggatgatgagtcgtttaatgtcgcttttgcagcatgtagaagaggagttaataatcctgtctgatatcggaggggttaattgaagtatatgaagcatttttttctaatcctttttgggatttcttctccatttatatgtttggctacttctgttgaatttaatgttacaaagggaataaaagcatcaatcacttgggtggataataaaaaagttgagtatgaaattacaggtagtgatcgtgtggcaaagagaggatattatgatgttgatacggaaaataatatccatgttaaatatggtgattataattttgatggtaaagaagattttgtgatttggtatacagatgatggtatgggaatttatgatatatatagggtttttctctattctgagaaaatggctgactttaaagaaataaagccatcatgtggcgatgattttataaatttaaatctgaataagaagaaaagagagcttattagtctgtattattctcataatgaggcgcaaagatgtattactaatgtttttgttggcgagaataaattaaagtgacaagtggtggtcttttatttcaggagatgattaattgataattattttattctttttgggatgattattggttagttctacttatggtgaagaaaattataaaaatattcattttaaaaacgcaacgataaatattcctgccagatgggtagctaataaaaaagatgattgtttattgattagtaaaaatcatataaatgtgttcagttatctttatgtatgcacagatgcggcaacgaataaaaattctttttttacaaagaatgatgatggagaatgggaggccgttactgatggcgtccctgttttagctgatgtaaatattacgccaaaatttattggcatgagtgcaatcgtttcatgtaggtacaaagatgatgctgggtatcatatagaccagtgctttcaggcagtgatagtattgtcaacaaacataatgtttgtttttattggtagaggcgattcatccttatttaataattataaggaaatatatcgctcattcaaggttaaatagcatgtgattaattgatggggattgggtgaatgtttttcattaattacgactgtgtgatgcttcataatgagcagactggatatggaattaatcaatcgatgagaatatactttagatgaagtggataattatggttttagttttttctttttctaatgtttatgctgaagactgttcacaacaagactttgataaagcggatatggcgttagactctcttgcgtcatggaaagctgtcgatggcttttattcccgacatagtcaatgtgatgtgggctacctccgggaaggcacgtcagaaaaaattatcagattgttagtggatagatggggagaattgaatgagttatctgcgcttatcaaaaggaaaccagcacttggcgattatgttattgatcatattggagagatactcgatgtaaaagatgttgaaaaaataagggattattcagcatctcattgccaaattgatagtaaagatctatgtaaaaaactgcacgatgcagctgtttatattttaccgtacatgtcttctcagtatcaatatcttaataattgacgcttatttagcaatcatatcatgagtttttaattgaaaaatacaacaatgcatgatgacaatattttattatatagctttcaatatataacccaatattaatgccgattatgaataattatagattaactttttctttatgtttactgcgttcggccatattgtttggcattattttaataagtgttaattgtaataatcaaaagagtaaggaattggttcttcctgttgattccacgcagtttacacaattggcttgttattataaagatattaattccgatgataatataatggagttaaaattaccagatgaatataaagagaaaactaacttatttaatcaacaggaaattaaggtgccggtaaaaggtgagagttttctttctccgtatattggtgatggtgtccgttattatgaattagggtactttgaacatgatggtaatacttacaaattgataatttataataaaattggagagtctgatacgttattgcttaatgtacaaataaatagttatgatgcaaaaggaaacctggtggatgctttattgcttagtagcttttttgcttatgaagacatcgtgcgtttttctgattttgtcatccgccaggattacacaataagcattgatagttatgttatatacaggtggtatgaggacagcaaagatggtcatcttgtaactataaagtttaaagatcaggcgcctcagatttatataaaggaacaatatcaaatggaaaatggtcgattcaaattgatatccagaaatgcagtatcacagggtgaaaaaagaagcgagcgttaaatataccatgcttacgacattaataattgtaatggaggtgttaagataatatggatagcaggaaagaatgaggaacgttatggaaattataaatagattgttaatttcaactgatctcaggttaatcataaaatttcagtttccgcgccagatttattcaacgcgcagatagtgcccgtcggcgcggacatttgcgccaaaaccgcagtccacaaacgtatcagtgctggcatcaatggtttcagaagaaaaagccagcgaaatgtcacagtgaatatcatcgccttcccgaagcgccacgatggctttatcgttttccagcgttatctctgcgtagaactcgccgatattggggccgaagtagatccccattaaaccgaaccagtaaccctgaaaattaacctgatagcgcgatggggtgggtaatgccttcacgctaagcacgttccaggaggcgcgcccggcatagcgccagtattcacccgccgtggaaaccggtggcggcaggaccgatagcttatctttgatcagtttcaggttgtagatcgacttgctatcattcggccttagcatcagccaggcgcgggctttacgccactcgccttcgcgtatccaggttagcgccacgttgttgtaggccgtcgcgatggcgttgtcgtcaagggcgcagctttcgctccatgcggccagctgttcaaaagcgtcgagtgctttggcatacttttgggtcttgtaaagctgttcgccctggctggccaaaactggaatttttgcgcagtcggcctcgatctgctgctccgtaatttcagccctggcggtggcgaagagtagaagcagggcgcaaagaaatagagattttctttgtattatcactccattacaccattgagttgacctgtcccggcagctctgaattcgggatacggacggtataccaggcgaaacgaaagcgtttccagaaagaatcgaaatgcaggtggtccaggcaatccataacgatttcattatccgggtaaagcgtgaaggcaaaatgtgcccagcgtgcgcttagcttcatattaaacagcgttcgatcgtgtttattaccgtgcaggcgcgatagggtcaccatagcgtgtagcgtgcctttgttggcctcttgttgcaccagttccagatgcttatgcgccagcgtaatatccttcacttcaaaaatattcagcaggaacaagccccaggcctctttatgcccgaactgatgcgccagccagagattatcgagcagttctttttcataagcggaacgtttttcggtatcaagttcttgtttactcagacgctggttgcagatgccgatgctgaaatgaatattttgcaggtcattttcatagtcggtatagcctccgttatctattaatttgtacggggtgctctcgcgcagcgctaaccgccggtgcaaaatctccgccgcgcgctgaaaataccctaacgcgatggcaggatcgtaaggtagtaggccgttgttctctttattattgtgttcaaggcccagcaggtttagcgcggcgggtatatttctttgtgcgcccagctctgccagcggcacaaaatgttccgggagcccgaaccagtcgaaatttttaatcgccgcccgccagttatggttatattgaatgtcggcgacgctatcgagccaggcgaggccttgcgcctcatccttttcgaaacccaataacccggcgtactgaaagtagccacgacggattttcggcactgcgaattccgtttgctgcgcattctgacagagaaaattatacatccaccaggtgtcaggaaaatcgcgcagggcgaactttatcgtgtcatcaaagaagtaattgttgaacttaactttttccacgatcgaacgctgaagggttcgccagagcgcgtcattatcgtccagatcgctatagcagacccgcagccacttcagcgtgttgtggcgagattcctggatatgcgctcgcaggctaatctcttcggctttggcgataatgcgttcctgttctgccggggagtcaacctctttgatgcgcagatcgcggtgatcgtcccaccagatcaatagctccagatgttcacgttctgcggcagaaaggtgatcgcatacgcttgattccagaaattcgcggatttcctcgtgagaccctccccagcgcggcatacgaaacgggatatattcatccagcacgtaaaatgccgtcgggaaaatagccaggcagacggcgagccagtatttttgcccggcatcgtcattgcactccggcagcacggacgggcgcggcaaatttgggcaaaccgcgtcggcaaacgacagcccggaatgggccatcagcgcatccacctcctgcggtgaatggcgatgatattcagccagatcttccattaatggctgcccggcaacatccgcgccctcgaggaactcaaccagccagtcgggctggccgaagacttttgagttggtgctggtcagggccgccgccatccactggcgcggttcacagtcgatagcattgagcgcggcgatgaccatccgttcgttgcaggcggcggcgcagatccacatcgctcgggtggtttctctcgcccagccatagctgcggtaaagccacgcacggtgattccagtattgcgcctcggcaagccaggcgtgagtggagcggggacgagcgcgctgccagtttttgatcagcgctaatccttgcggcccagcctcaaccagcgtgtccatatcgtaaaaagggttgtccatttgattccaggcgaagaaatagcgcttttccgcttcgcggctggtaaagctctccgtcagcgcctggttgtagcgttcgtccagttcgtcatagcgttcttcgcgcagcaggccgggaatatcggcgatatgccactctcgttgcccgtcattgaggggatttttgtggttgcacatctcaaacatagcgttgagcagacgatcatcctgttccataaatagtcctttaaatcggctcgaaaattttgaattcattccacggcagttgtcgccagcggctgacagggtcttgcagataatgggtggcttcctgtaaatcccgtccggcaagcgctattggcgtgtcacgtagcgtgagccatacccggcgggcgcgaacgtaggcggtggcgtaatcctcccaggaatcaaaacagtcctgagcgcgctgggcgttaagtaataacaccagccaggcctcgttttcgtcacaccagccgagcccggcgatacagcgggtcagaaaggcggttcgcatgcagtcgaaagccagcgcgtcgcggacctggccctgggccgccagatgatgataaaacgtgctcggcgagctgccgatgcccgcaggccagcggcgtaagatatcctcgaccttgtggcgtaacgccgcgccgttgaggttttcgctcaagcccagctctttttttacctgctgtgccagatagcggtgtttgtcatcgtcaagtttgaagaccagctcaacgcctttgatcggtagcccgttgcgccgggcgaggatatcagctagcgccagcgcccattgccgccgtcgggtatcgcgacgcagatccttcagacgatctttttctttctcctcggcgatacgggccgcaatcagcggtttgtttttttttgtagttgcgccagctaaaaaatagggcggcaataataagaacaatccagaacattattgcacctccttgatgacagggaggtaacgcgtggtttgtagcgtcaggctttcaatttcgaaaggttcactactggtgtttttcccggcaagcgtagggtgccattcatgccgtggaaacagcatttccgcagccgtcgccacgttaggatcaacaacctgaaggtagcgcagcgcctccggggcgctgtgcagcagcagccactgtaaagctaccgggggagtggggaagtgttccattaaatgaaaattgtcatgcagcacattgagcagaaaattgaggtcatgaatatgagtaataaatttccaacctgaatattccggcgtcgattcataaactattcccatcccttcgcaatcagcgtggcgctcaggaagtggttgcagatggcgtaacagagataaaacatcgttagcatatttcttaataggatggcgattttgcttacctttaatctgatcaatgctcaggccgttattaccaaccaccaggcttattgtgacgtggggaatattattgccgtcgcgcaggctgaacaggcgaagtttctgttgttcaatttgccgggcgtagtaatcgccgtagccgccggaaagcgcgcctttattatcaaaatctccgacgcagtgttgcatatgccaggattcatacgccatctcactgcgcaggccggggtttgttgcatcaagctcaaccagcacaccgttattcaccgccatcaccggttttagcgcctcgctgttggagggataccaaccttgttcacgcaggtgctgcattttttgatgctccgcttcgcgcattgccagcacggtaaagcagttgatgcgctgtagtttagtttccagccgcgttccttcctgacgcgaaagaaattccactaaatctctttccattgccacaagttgcgggtgctgaacgttaaggtagtaaaagcgctcatcgccacccaggcggggatttctgcatcagggctaaaataaacggcataatcagcgacggagcgcacagggtaaacgtgaggaaagtcaccaatgatccaacgataaaaatgattgcttaaccagcgctggatattttcgctatcgccgcgttgttggctccgggaaaaaatagatgattttacatttggcgcatttattatattgcgtggtttatagcggtgagatgacgtttctgtcataaaaatccatgtgtaattaagctggcattatgtttatgtatttttagattcacttaatgaattaatgcgcaataagtttaaaaaactactcacagtatatcggtaaactaaaaagagcggccaaataatttattgtccccgatcgcgttcgtcgtggttttcgggataccgctcggccaaatgaaagagggcagtgtgttaattccgccagaatagcgttggcggaaaatatcgtcttacgaccttgttattgttatgccaataatcattataccaggcgacacgcatccgcttcccagcgatatcccaccccgtagaccgcgcgtataaatgactgttcggcatccagcgattccagtttacggcgcaggtttttaatgtggctgtcgatagtacgatcggtcaccacacggtagtcgtcgtagaggtggtttaacaactgctcgcgggaaaaaactttacccggttcaagcgataaggtttttagcagacggaattcagcgggggttaaatccagcgctttaccacaccaggaggcctgaaagcggctttcatcaatcattaacgggctttcggcatcctgctgctggagttcgcgctgcggtttacagcggcgcaaaatggttttcacgcgggccacgacttcgcgtgggctgtaaggcttacagatataatcatcggcgccgatttccagcccaagcagccggtcgatctcttcaattttggccgtgaccatcacaatggggatgtcggaaaaacggcgaatctcccggcatagcgtcagaccatcgatacccggcagcatcagatccagcaggatcagatccggcggcgtttgacgcacatacggcagtaccttgtcgccatgattgatgagcgtgggggcgtaactcgccgcgcgtaagtagtcaataagcagctgtcccagcttgggttcatcttcaacaatcaaaatgcgcggcgtgttttcatcaatgggtaattcagtcatacttctctctgtaaatcgcgatccagcggtaactctactgtaatgctaaccccgccaaaaggcgaatgagcggcgtgaagatgaccgttatgcgcgtgtacaatattgacgcatatcgccagccccagtccagaaccgccgctggcgcggttacgggacacttccgtgcggtaaaaacggtcaaaaagcttttgtaactgctcatcgctgacgcccggtgcagaatcggcaaaggtcaggaataatgatttgtcgcgttgttcggcggaaatatgcaggccgccgccgctgtcggtgtagcgcagactgttttccagtagattattaaacagttgcatcaggcgatccgggtcgccgaagacggtcatactatccggcaacgcgtaatgtagcgttagcccccggctggtaaagcgttctctaaacgcgccgccagcgacttccaactggggaacaagatcgacggtcgttttttggtaagccagcgcgccctcgtcagacaacgacagctgatgcaggtcgtcaaccagtttggtaagcgtaccgacttccgcctgtagcgaggtaaccgattctggcgtgaactggcgaacgccatcctgaatggcttccagttcgccgcgcaataccgccagcggcgtgcgcagttcgtgggaaatatccgccataaagtcgcggcgcatctgctgatttttttccagcgtgctggcaagctggttaaagtcttgcgccagttttcccagctcatcggcgctggttggggtcacgcgcgtggtaaaatcccccgccgccagcctgtgcgtaccctcgaccaaccgtttgaccggggcgagcaggccacgcgccagcaaaaacgtcgccagcgcggccagcaaggttgataacgccacgatcatccaactggcacgccgctgctgcatatcaaaattaatatccgtattgcgcgtcagccgctcgacaggagaggcgataatcgcgcctacttcgacgccattaaccagaatggggcggcgagtaccgtcatgcggcaccggaccgcgtgggccgaccagcacccggccattttgatcgacgacccagaactgggtgcgccaaccgtgcggcggcataccggggccgggtttatcccggtcgttgtcatgctcaaatgaacgcagaatctggaaaacgaagcgatcattgttacgtaaaaaacgccagttgccgtgttgctggtactggtcgcccagcgcatcgcccagcatttgtagccgctgctcgttgccgtgtttgatatagtcaataaatccgcgttcaaaactgacgcgcacggcccaatgcatactgatcagcagcacgatgcaggtggcgaaaatcgccagaaacagcttgccggtgattccgggccgccagactttcattacaggctccttttacgccgtgaaatgaccatgttttgctgtgtatcgttcggcacgcgggcaaaaattatcgccggtagcgcgataataaccgccatacataaccaggtgtacataaagacgtgatgtgtggcgctactgtctatcccgatatgctgttggccaaacatacccagcagcattccggcaatagtgacgccaatactcatcgagagctgcataatcatcgataataagctattgccgctgctggccagcgtatcgggaaggtcttttagcgttaaggtattcatggaagaaaagcgcgccgagttcaccattccctgcaaaagcagtaccagcggcaggagataataccagccgagcagcgcgaccgacataaacaacaggctaaccaatgccagtccgagcgtggtcgctaccagaacccgacgatagccaaaacggttaactatctgcaccacaatccgcttcattcccatgctgcccagcaccatggggatcatcatcaaaccggcatgaaacggtgaaaaaccaagaccaatttgtaaaaagaccggcgtcataaacggcagcataccgctgccgatacgcccggcaaaactgcccagcaaccccagtgaaaacgtgggcgtgcggaacaatcgcaggctgaataacgcacctgagttttttttggcatggaagagatagagcagaatggctgccgcgccacccgcagcaagtccggctaatgtccagggcgaaatccccatgcttttactaccgtccagcgccagcgtgagtaccgccatgccgatagctaacagcaggaaccccggcagatcaaagcgccgggtctctatggtgtagtttggcatcagcataaaggtcgccatagcgccgacaattcccaccgggatattgatcagaaagatccagtgccatgaagcatattccaccagcaccccgcccagcgcggggccgagtaacggcccgatctgtcccggtagggcgacgaaggtcatcgccgccatatattgcgcacgcggcacgattttcatgaccgtcaggcgtccgaccggcaccatcatcgcgccgcctacgccttgtaaaactcgcgctaataccagttgattaagcgtaccggagagggcgcaaaacagcgaacccagcgtgaacagcacgatggcggcaaagaaaatattacgcacgccgattttgtctgccagccagccgctggcggggagcatcacggcgacggtgagaacatatgacaccactaccatgtgcatatgcagcgggctttcccccaggcttttcgccatggaaggcagcgcagtgttgacgatggtggtatccagcgactgcataaaaaagccgaatgccacaatccagagttgccagcgggtgttgtcaggaaattctgtcatatctctactaccggtttgctatttttacgcgaaaaacgcagccgcagacggtcgaaaaagaggtacaccaccggcgtggtatagagcgtcaggagctggctcatgaccaaaccgccgacaatggttatccccagcggctgccgtaattccgaaccgtctccgccagataacaccaatggcagtgcgccgaacagcgccgccagcgtggtcatcattattggacggaagcgtaacaagcaggcctggaaaatggcttgttccggtgtcaggccgccgcttcgttgcgcttcaagcgcaaaatcgaccatcataatggcgtttttcttcacaatgccaattaatagcatgatccctatcagggcgattaggctgaaaggggcattgaagagttccagcgccagaagcgccccaacgcccgccgatggcagagtagagagaatggtcagcggatggacgtagctttcgtacagtatccccagcacaatgtagacggtagcgatcgccgccactatcaaaataagctgtgaattcatggtctgctggaagacttgcgccgttccggaaaaactgccgcgtaccgtcgaggggacgccaagctgcgtcatggtgcgatcaatggcctccgtcgcctgcgataacgatgtgccggtcggcaagttaaaggcaatcgtggacgctgcggaaagtccctgatggtttaccgacagcggcgcattggcgggccgccattgggcgaaataagagagaggaatcgcttttccgtcgcggttgataacgaacattttctccagcgcgctgatatcctggctatagcgcggatcgacttccatcaccactttatactggttcatcggctgataaatggtggaaatttgccgctggccgaaagcgttatttaacaggctgtttgcggcctgaacatcaatgcccagccgtgacatggtgtcgcggtcgtagataaggttcatctccgcgccgttatcctgctggtcggagtttacgtccgccagttgcggcagggccgagagcgctttgcgtattttcggctcccactcgcgcagcgccggcagggagtcagacagcaacgtatattggtaactggcgttagcctgccgcccgccgacgcgaatatcctgtaccgccatcagaaacagcttggcgccgggttcttttgccagtttgacccgcagtcggtcaatgacttgctgcgccgtctctttgcgttcgccgcgcggcttcagcgtaataaacatcatgccgctattcaccctcgatccgccggtaaaaccagtgacattattcaccgccggatcgtcgcgaataattttcataaaatcctgcagcttgccgcgcatggcttggaaagagatgctctggtcagcctgaataccgcccatcaacacgccggtgtcctgctccggaaagaatgttttagggatggcgatataaagccagatgttcagcgcaacggtgccaagaaaaaccacaccgacaagacgcgtatggttaagcacccattttaacgacgtgccgtaaccctgttgcaaggcgaccagcaaacggccaacgccccgtttacgcggttgggtgcgcggtttgcttgatttaagcatccagccgcacatcatcggcgtcagtgtgagcgagaccaccagcgaaatgccaatcgccaccgagagggtaacggcgaattcccgtaataatcgtcctggcaggccgcccattaacagcagcggcagaaataccgccaccagcgacagactcatggagatgaccgtaaacccgacttcccgcgtaccctgtaatgccgcctgcaaaggtttcattctcgcctccagatggcgggcgatattttccagcaccacaatggcatcatcaacgacaaatccggtcgcgatagtcagcgccatcagcgacagattgttgaggctgaagccgcacagatacatggcggcgaaggtgccgatgagcgaaacgggaacggcgacggcggggattagcgtggcgcgcccggaacgcaggaataaaaacaccaccaggatcaccagcgcgacagagatagccagcgtctcttctacctcttgcagcgatgcgcgaatcgtcggcgaacgatcctgggcgatttgtaaatcgatagcggcggggatcattgcccgcagttccggcagttttgcccggatgccgtcgaccgtctgaataatgttggcctccggcagcttgcggatcatcaacaaaatagcgggtttagcgttcgtcatcccggcgttacggacatcctgcaccgagtcggtgacgctggcgacgtcacccaggcgtaccgccgcgccgttgttatagtgaataatcagcggctgatattcggcggcggttttcagttcgtcgttggtctggatttgccagcggtggacgctatcttcaattgcgccttgcggtcggcgtacgttggcgctgtcgatcgcttcgcggacctcatccagcgagacgccctggttaaagagcgcctgcgggtttaagcctacacgtactgcgggcagggagctgccgccgacgtcaacgtcgccaacgccgtcaatttgcgcgatggtttgcgccagttgggtagaggcgaaatcatacagtttgccctgtgaccagctctctgaggtgagcgttaaaatcataatcggcgcgtcggacgggttggccttgcgataagtcgggcggctgggcattccgcctggcaacaagctttgcgcggcgttaatggcggcctgcacgtcgcgcgccgcgccgttaatatcgcgatcgaaattaaattcgagaataatgcgcgtactgccgagcgagctgctggaagtcatttcattgacgcctgcaatgcgtcccaaagaacgttccaacggcgtcgccaccgacgaagccatggtttccggcgaggcgcccggcagcgaggcgctaaccataatcactgggaaatcgacctgcggcagcggggcgaccggcagcagacgaaagcccagaatgccgcacagcgtaatggcggcggcaatcaaaatggtggcgaccgggcggtagatgaaaagggcgaaaaagcgcatctacgcctcctctttatggcgcggaaagcgacttttcacgtacagcgacaggcggtcaaacaggagataaatcaccggagtggtaaacagagttaatacctggctgaccagtaagccgcccaccatcgcgatccccaacgggcgacgtaattccgcgccaacgccggtactcaacattaatggcaatgccccgagcaacgccgccagcgtggtcatcagaatcggtcgaaaacgcagcagacaggcctggaagatagcgtcgcgcggactcatcccctgttcgcgttcggcggcgagggcgaagtcaatcatcatgatggcgtttttcttcacgataccgatcagtaaaataatgccgataatggcgataatatcgagctcgctaccagcgatgatcagcgccagcagcgcgccgacgcccgccgtaggcagcgttgagagaatcgtaatcggatggataaaactctcatacagcacgccaagcacgatatacatcgccaccacggcggcgacaataagccagacggtgctgcccagcgccgcctggaaggcgagcgtactgccctgaaactgcgttgtaatatccgctggcagggcgagcgttttttccgtatcgagaatcgcctgcaccgcatcgccgagcgaatagccctccggcacgttaaacgaaaatgtcgtaaccgggaactgatctaaatgattgatggagagcggggcgaagcgctgctcaatgcgggcaatcgcgctgagcggtacggtgccgccgtcgcggctcgtcaggcgaatcgtctccagcgccgccagacccggcgtgctggcggtattatgttccagcacgacgcggtactggttcgcctgggtataaatcgttgaaatcaggcgttgtccgaacgcgttgtagagcgcgttatccacatccgccatgctgatacccagacggctggcgctgtcgcggtcgacattcacccaggccgctaatccccgatcttgccagtcgctgcttacctcagagagctgtggtaacgactgtagcgcgttctgcagttttggcacccagtggctgagcgcatcgagcgtcgtggcctgcagggtaaactgatactgcgtgcggctgacctgcgtgtcgatggttaaatcctgcgtcggctggagatacagcgccacgccgggaatcgtcgccacggcggtttgcagccgggagatcacctgctgcacgcggtcatcacgcgcatccagcggcttgaggttaatttgcaggcgcgcgctattcagcgtgggattagcgccgtctacgccaacaaaagtcgtcaggctttgcaccgccgggtcctgtaatatccgctccgccacctggcgctgacgttgcgccatactggcatacgatgatgattgtggcgcctgcagcgtcccctggataatgccgttatcctgtaccggaaagaaccctttcgggatggttatccacagcataacgctgagcaggagcgtggcgaatgccacgctcaatgtaagccatggatggttgagcactttcgctaatccgcgtccgtagctggcgatcacgcggtcaaacatccgctcgcaggcgcgggaaaagcggttttgtttacgcagagactgccggctgagcatacgcgcgcacatcatgggcgtaagcgtcaaagagacgacggcggagattaaaatcgctaccgccaacgtcaccgcaaattcgcggaacagtcgaccaacaatatcgcccataaagagcaacgggatcagtaccgcaatcagggaaaaggtgagggaaataatggtaaagccgatttcgcccgcgcctttgagcgccgccgccagcggtttttctcctttttcgatgtagcgcgagatgttctcgatcaccacaatcgcatcgtccaccacgaaacccgtggcgatagtgagcgccatcagcgtcaggttattaatggaaaaatccaaaaacaccatcactgcaaaggtgccgataagcgacagcggtacggcgacgccgggaataattgtggcgggaatattacgtaaaaacagatagataatcatgacgaccagcgcgatcgccagcatcagttcaaactgggtatcgcgcacggaagcgcgaatattggtggtgcgatcggacaggaccgtgaccttcaccgatttcggcaggctttcggtaagctggggcagcatctggcgaatgctgtccgctgtcgcaatgatattggcgccgggctggcgttgaacgttcatcacgatagccggagcttgattcgcccatgcgccgagccagctattttccgccccctgttcgacggtggcgacatcgcccagccgtaccggcgcgccgttttgatacgcgatgataagcttgcggtattcgtcggcagactgcatctgatcgttagcagaaagcgtcaccgcccgttcggggccatccagactgcctttcgccgagttgacgttggcgccggtaattgcggtacggactgtttcgctggtcagaccgagcgcggcgatagcctgagcattcagttttacgcgtaccgcagggcgctgcccgccggcaagcgtcaccagcccgacgccggagacctgtgagatcttctgcgccacgcgggtttctaccatgtcctctacctgggtcatcggcatcgcgtttgaggtgacggcaagcgtcataatcggcgggtccgccggattgactttgctataaatcggcggattcggcaggtcggaaggcaataaattggtggctgcgttaatcgccgcctgtacttcctgctcggcaacgtccagcggcagcgtcaactgaaactgtagcgtcaccaccgatgcgccgccggagctttgcgacgacatctgcttaagtcctgacatctggccgaactggcgctcaagcggcgcggtgacggaggaggtcatgacatccgggctggcgccagggtagagcgtaaccacctgaatagtggggtagtcgacctccggcaaagcggcgacgggcaggaagcgatagccgataatcccggcgagtaaaatcgccgccatcagcagagtggtggccacggggcgcagaataaacagacgcgaagggccgcccgtgctgcccggaggtaatacctgcatcaggcgcgcgctcctttttgaccttcatggcgggaaggggatttttcatccgccatggtggtttgcggctcaacgacctcgacttttgcgccttccgtcagccgatcaataccatcggtaacgacgcgatcgcctgccgacaatcctgcgctgatcaccacgtttcggttatcctgaataccgatttttacccgcttcttgctgacgttattttcgtcgttcagcacccacacaaagtggccctcattgcccatttgcaccgccgcggcaggcaccacaacggcattttgttcggtatcgaccagcatccgggcgttcacaaattgattggggaacagcgtatcgtcctgattggtaaagcgcgctttaattttgatcgttcccgtcgtgggatcaatctggttgtccagactgagcaacacgccttcgctcaatttgtgcgagttagttcgatcccaggcttctacgaccagcgttttccccgctttctgtgcctgaaccacggtcgcgatatcgctttccggcagagtaaaaatgagatcaatcgggtgcgtttgcgtaatgacgacaatacctgcggtatcgctgctggaaatctggttgccgacatccacctgtttcagacccacgcgtcccgagaccggggctgtgatacgactccagtcgagctgtagctgcgcgctggcgacattggcttcatccgctttaatggttccctgggtttcgttgaccagcgcctgttgcgcatccagttcctgacgggaaaccagattggttttggccagttgctgatagcgcgccagatcacgacgcgcattcgccaacgtagcgttatctttcgctaactgtccctgagcctgcgccagggcgaccttaaactggctgggatcgatttgcgccagcagatcgcctgcgttaacctgctgaccttcctgaaagtgcagggcgatgagttgaccatccacgcggctacgcaccgtaacggtattcgctgcggtcacggtacccagcccgctcagatagcgcggtacagcctgtgtggtcgcggtcgcggcctgtaccggcgccagagggccgtcgcgcataccgcggcgacctgcggcggcggtatgctgcgcttgcgcggcgacgcccggcgcggcggtcgggctttcgctacggctatgccagaaccagaatgcggcggcggccactacaaccccaatcgctattgcccagcggaaagtattactgcctttcatcggtataagtttctcatcctgaaacgttttgcggaatgttgcttcctctattgtagtcagcagggaagggagaaaaatggaggaattatggaacacggtcgggattattctgaatggcgacccgctttgcgaggcgctacgcaactctcatcggtgaaaatcgttaacgcgccggagtgcggtaaagtgccggcacggcaatgaagataagccaccgatttcagcaggatgctgaaacgggaaagcccctcccgaggaaggggccaaaataaggaaagggttatgatgaaggtagtcatcataatggtgatactcttagtgattagcctaccagcttactaagacaccagggggaggaggaatcctcccttaccctcactcctgacgttaagccacatcaagaataatgtcaatccatcagcgctgggcttgcgaggcgcttagcggaaaacgacctccgcccagcgcgccagtcctgcggtgacggagccgaaatcatcgccgccagcgacgggtatgcccggtagctgttcggaaagcgcttttttaatcaatggcgaacgggcgctgccgccggtcagatagatgacatccggtttttcctgcgcgctgtccagcgccagttgcacctgttccagaatacgcgccagcggttgatccagcgccgcttccagtccttgctggctgatagcgaccgccaggtcgtcgctgataaatggcagcctcgccgtaacatccgcctggccggaaagggcgattttgctctcttccgcgcagcgtaccaggcggtagctaagccgctgacgccagaccttgagcagcaacgcgaccttgtctgcttcacgcgcgttgcgaaccaaatcgttcaacagacgaccattcgcgctactgtaaaaatcgctttgcgccgggacgtcgttaatcgcgacggcgttccaccacggcagcaccggcagggcgatacctttttcggtttcgccgcccatgcccagcaaaggcatcagatttttaaaggccagcgcgatatccagatcgtttccgcccacgcggcaaccgctgtgccccaacaggctgttttcacgatcggcgcgctgacgccactgcggccccatcagcagcatggaacagtcggtggtaccgccgccaatatccacgaccagcacacgcttctcttcccgcagcgtagcctcgtagtccaggcccgctgcgaccggttcatactggaataccacctcctgaaaaccggcgcgttttgctgcccgctccagaataccctgcgcctggcggttcgcgtcatcgccgccgagtccctgaaagttgatcgggcgaccgatcaccgcctgagtaatggcctccggcaattggctgtgcgccgtatgaagaatatgtaccatcatggcgcagaccaaatcttcaaacagcgcgacctgctgcggtttcaggccgctggcgcctaaaaaggatttcggcgatttgacgaaccagacttcctggggatcgtcaatatagtgcgccagcgacgccagaccaaactgtacgctttgcgcgccaacctcaatatcttcctcgcggttgtagcgtatagcgcggcgtagcagcgcctgggtttcttcgtccgttgccggcacatcatgatggcgatacagccactcgctcaccgcttcgcgcgtcggcgcacacagcatagacggcagtaatgcgctgttattctccattgtcagcaactgtggatgcccgtcgcgcataatggcgaccgagcagtttgccgtaccgtaatcaaatcctataaacaccttaaaatccccatgccagtgaagaaggggcgtgactttagcgaaatgtcgtcgcggcgacaactggaatatgaaagcaaggcgttacgtgcgattagcgtttatgctgaaaggtcaaataaaggagaaaagtatgtttaccctgagctggcagccgccttacgactggtcgtggatgttgggctttcttgccgcgcgtgcggtggacggcgtggaaacagtaggcgagggcttttatgcgcgcagcctggtggtgggcgagcatcgcggactggtcagcgtgaggccccatctgcccacccacactgtgcaggttagcgtgagcgccggattacttcccgtcgcgccggcgtgtctggcgaaagtttcgcgtctgtttgatcttgactgccagcccgagcaggttgccgccgtgctggggccactgggcgaggacagaccggggctgcgtttaccgggatcggttgatacgtttgaacagggcgtgcgggcgatactggggcaactggtgagtgtcgcgatggcggcaaggttgacggcgaaagtggcgcgccgctatggcgaggcgttgccggatgcgcccgattatgtctgttttcccggtccggaaacgctggcgttggccgatccgctggcgcttaaagctctggggatgccgctgcggcgcgccgaagcgctgattcatctggcgcaggcgacgctggcgggaaaactggcgctctccgcgccgccggatattgagcagagcgttaaaaatttacaaacatttccgggaattggccgctggacggcgaactatttcgccctgcgcggttggcaggcaaaagatatctttttgcccgatgattacttaattaagcagcgcttcgccgggatgacggccgcgcagatccgtcgctacgcggagcgctggaaaccgtggcgttcctacgcgctactgcatatctggtatacccacggctggcaaccgtcaatggatagcgaaatagctggtattcagtaacaaatccagcggttgcgcttcggcgatagtgtcgccataaatcagatccacgccaatacgggagagcgtatccagcacctgtgggttttgtaccggcccggcgagcgttttgatgtccagatgctgggcgtgtccctggatgatcgaggtcagcatttcatccattaaactttcatgaacgttggcgataaggtcgctatccagcagtaaataatcgacgatatgcgggggcagtaaattaaacagctgtaaatcgcgcccgacatggctgagaatcacctggcagccgcgttgccgcagttttcgcagagtcgcagcggcggtctgcgcctgcttaacgataacgtcagccgggataatcaggtgtaataaccgtggcggcagtgggctatgctccagttgttccagcagctcatcaataagggtcgcgctgtataatcccgcggcggacagcggcagcgcaacgcttaatcccttgctggcgacggcggtcgccgcatggcggaaaaactcatggaatacccgtcggtcaagcgcgtgatgcagcgcggagtcggctaaccctgcccggaacgcgcgctcttccatcacttccccttcgctggtccacagcctgagtgagaccagccaaaagctggtggcctccggcgtacgcggcggcgcgacgtttctggcaagcattagcaggaggttatttttaatcatatgccactgttcttccagcggcatcattccctttgaggaggttaatgcgtgctgcggttcgtacacggtcagacggcctcgaccgctatttttcgcggcgtagcaggcaatatcggcctgagacacgacctctgtgagctggcagttatgttcatttatcattgtgatcccggcgctggcgccgatccgatgcaggcgtccttcccacataaagtgatattcattaacggcgttgataagccgcgtcgcgataaagcgcgcgctgtcactattacaatccggtagcaacaggccaaactcatcgccacccaggcgggccaggagatcgccggagcgaagcatactgagcatcagtgacgcgagctcgcgcaataaggcatcgccggcggcatgtcccgcgctgtcgttaaccgctttaaaacggtccagatcgataaacaccagcgcatgatgttgaggcgattcctgtattgtttgcaggcgctgttgcagctgtttttcaaaactggcgcggttggcaagttgggtgagggcgtcatgcgttgcgctgtagctgagctggcgtaacatttttcgtgattcggtaacgtcctggataaccagaaccgaaccaatcttatcgccgtcaagcgtactgagcggcgtgatactgtaatgaatatcgtagctaccgccgttatgacaatggagcactatctcctgttccatgtccgatcgcgacctgttggcgcgataaatatcctccagcagcggccccttattacctgacgtaatgcgcagaaccgttaataatggcgcgcctaaagcatcctcttgccgccagccgctcatcttctcggcgatcggattcataaaggtgatattcatcgcgacatcaatacacaccaccgcttctccgatagagtcaagcgtgatgtgcaaccgttctttttcctgaaacagcgcctcgttcgcctgtgtaatacgctccatcaaccgctggttttcctgctcgctttgcttgagatcgttaatatcttcaatctgagcaataaaatagagaggttgattgtctttatgacgaaccagcgagacggccagcagcgcccagacgacatcgccgttgcgggtgtagtagcgtttttccatggaatagctgttgatgtcgccgcgcaccagcatgtttagctgttcaaggtcgttattcaggtcttccggccaggtcaattgctgaaatgtcatcgtgcgtaattcatcctggctatagccaagaaaatggctcagagatttattgacctgtagccactgaccctccgtaccgaccagcgccataccaatggcggaatactccatcgcgttgcgaaagcgggattcgctctcggtgatatgtttgcgctccgtgcgaaacgcgtacatcaccatcgtcatcatattggcaggcagcaggatcattaaaaaaggcagccacggcatattgaccatcacgtcggttttcggcgtggcgagcagcgtggggtcattggccagcatgagcgagaccacgataacggtagctaaaaaaattaaaaacgcctccattcgcggcaggcgcaccgcactccacatcaacaggacgataacgcacgtaaacggccacggaatatagcgcatagcgagccagcttagcgccagcgtaatgaccagcgtcaatagcgtttccagcaacagatgcgggtcgcgatgacgcaacagatagtgtggtttaaacagtaaacctaacggcaccagcgtcagcgcgccgatggcttccgataatacccaaatcagaaacgctttcgaggcgaccgcttccggcgctatcagccaaaataacaggccgccgagtagcggcggaatcacggcgctgccgatagccagacgaaaccagtcattcaaattttgtaaggggttgtagctggggagcagttttcgtagcagtatcgcgccagtggccgcctcgataatatttattgccgtccagctaaagttaagcgaggcggcaggaaataaagtcagtgaggcgccgatgctgccgagcgagcaggcgaccgcgatcccaggccacagacggcccgcatggcggtaaaacgcgaccatcataatggaggtggggaaccacagcggcgcgagttgggtgccgacacgcgataatacgagcgaaaagagcgtaaagacaaacgcgaccaggcctaaactgaccagacgcaatagcgggtgggggacggtaacgaaaacatgttgggatggtttactcattaccactctatccgaatcgccggtaacgtcgcggaataccggacgcgtcagtttactctgtgattatgctagtataaacgcgtaatgatttatacgctgactgaatataaattgtggctcccggcgtattcctcctccagacgggtcgataaatccgctgtccgcattaaaactgaacgcttttacgtcgcgacgtcgaatgcgccgccaacaaattcaccgtggcatagcgccggactggtatcgcgctgctgaaatccctataattgccgcgtttggcgtttcggcgccccccttctttacatccaggttaatcaggtcgctaaatttatgactgatcagtctcatcagtgcgtcattatcggtatcgctggcgcatcggcttccggcaagagtcttattgccagtaccctttaccgcgaattgcgtgaacaagtgggtgacgaacatattggcgttattcccgaagacagttattacaaagatcaaagccatctgtcgatggaagaacgcgtaaaaactaactatgaccatccgaatgcgatggatcacagcctgctatttcagcatcttcaggcgctcaagcgcggttcggcgattgaattaccggtatacagttatgttgagcatacccgtatgcaggaaacggttcgcgtagaaccgaagaaagtgattattcttgaaggtattctgttactgaccgacgcgcgtttgcgtgaagagatgaacttctctatttttgtcgatacgccgctggatatctgtttgatgcgccgtatcaaacgcgatgtgaacgagcgtggtcgctcaatggattcggtgatggcgcaatatcagaaaacggtgcgtccgatgttcctgcaatttattgagccttccaaacaatatgcggatattatcgtgccgcgcggcggtaaaaaccgcatcgctattgatattctgaaagcgaaaatcagccagttctttgaataaatctggcgaattgtgtaccgttcagtgataacctggttagcccttgatgtgcttgatttaagggcttgatgcgcgaaaggagaaagtgccatgcgtttatgcgaccgagatattgaagcctggctggatgaaggccgtttgtctatcaccccgcgacctcccgtagagcgcattaacggcgcgacggtcgatgtacgtcttggcaataaatttcgaaccttccgtggccatacggcggcgtttatcgatctgagcgggccgaaagatgaggtcagcgcggcgttggatcgcgtgatgagcgatgaaatcgttttgccggacggcgaggcattttatctgcatccaggcgaattggcgctggccgtcacctttgaatccgttaccctgccaccggatttagtgggctggctggatggtcgttcctcgctggcgcgtctgggactgatggtgcatgtgacggcgcaccgtatcgatcccggctggtcgggctgcattgtgcttgagttttacaactccgggaagctgccgctggcgttgcgtccgggtatgctcatcggcgcgctgagctttgagccgctgtccggcccggcggcgcggccttataaccgccgtcaggatgccaaatatcgcgatcagcagggcgctgttgccagccggattgataaagactgagccattcggcgcaatactgccggtccattgagggtagcatgagacgatttctgacgacgctgatgattctcttggtcgtgctggtggccggattctctgcgttggtattgttggtcaatccgaatgatttccgcgcctatatggtgcagcaggttgccgcgcgtagtgaatatcagttgcaactggacgggccgctgcgctggcacgtatggccgcaactcagtatcctttccgggcgaatgacgctaacggcgcgaggcgccagcgaaccgctggtgcgggctgacaatatgcgcctggatgtcgctttatggccgctgttgagtcatcagcttcatgttaagcaggtgatgctgaaaggcggggtgattcaactgacgccgcaaacggaagcggtacgcagtgatgatgcgccggtcgcgccgaaagataataccttgccggacgtagcggaagatcgcggctggtcgtttgatattcgtagcctgcgcgttgccggcagcgtgctggttttccagcatgaaaatgatgatcaggtcacggtgcgcgatattcgtctgaatatggaacaagatgccgagcatcgcggcacgtttgatttttcgggacgcgtgaaccgcgatcagcgggatcttgctttatcgttcagcggaacggtggatgcttccgattatccgcataatttaaccgcgggtattgagcaactgcgctggcaattgcagggcgcggatctaccggcgcaggggattgaggggcagggacaattgcaggcgcagtggcaggaggcgcaaaaacgtctttcatttaaccacttaaatttaacggcgaatgacagttctctgaccgggcatgttcaggtaacgctggcggagcagccggaatggcaaattgacctccggtccagcaagcttaatctggacaacctgttgccgcatcatagcgccgtggctcagacaggcggcgcggtgtcgcaggggcaaaatacgctccccctgaccaggccagttatcgcgtcgcgtgttggtgcgccgccttatcaggggctgcaaagctttacggcggagattgctttacaggcggattcagttcgctggcggggaatggactttacccaggtttcgacgaagatgtctaatcagaccggattgctggatattactgagttgcaggggaaactggccgacggagagatgtcgctgcccggcacgctggacgcccgcaccgccagtccgcgcatcgaattccaccctcgcctcaaccatgttgagattgggactatcctgaaagccttcaattatccgattagcctgaccggtaagatgtcgctggttggcgatttctccggggcggatattgacgcagaggcatttcgccatagttggaaaggaaaagcgcatgttgacatgagcaatacgcgccttgaaggaatgaatttccagcaactggtgcagcaggccgtagagcgaagcggcggcgacgcgcagcagtcgcaggaaaatatggacaacgcgacccgactggatcgcttcacgaccgatctgacgctaaataagggcacgctgacgctcgacgacatggtcgggcaatcttctatgctggcgttaaccggcagcggaacgctggatctggttaagcagagctgtgatacacaatttaatctgcgtgtgctgggcggctggaacggcgatagcaacctgatcaccttcctgaaagagacgccggtgccgttgcgcgtctatggcaagtggcaggagctgaactataccctgcaagtggagcagttattgcgtaagcatttacaggatgaggcgaagcgtcggctcaatgactgggcggatcgcaataaagatacccgcaacggtaaagatgtgaagaagctgctgaataagctgtagtttttggccaaagggcagagccggatggcgaggctaacgcgcctccggcctgcctggtaagcaggccggggcaggcgaacagacgttacatctcctggtctggctcgccgttatgcagcggaattaactgcactttctgcactcgatggctttctacctgcaatgttttcagcaaataatcgcccacctgaacctcttcaccggtttgcggtatgcgttgcaaatattccatcaataatccggcaatcgtatggtattcccgtttttcatccagcggtagcggcacgtactgcaccaaatcctccagcggcatatggccgtttgctgtccaggaactgtccgggttcttctgaatatcgtggcgggcgtcaatttcctcgacttcattcggcagattaccggcgatagtctccatgacatcgcttaatgtcacaatgccttcaaccgagccaaactcatctacgacaaaggcaaaatgggttctggcgttacggaactgctccagcgcaggcagcagcggcaatgtttccgggaaaaccagcggttggcgaatcagcgcccgcaggttgagcggttcgccgcgcagcgattgttgcaacagatcgatgacgtggacgacgccgagtaaatcttcctgttcattttcacccgtcacgaccagacgcgtatgctggttcttttccagcagagcgcggatttccgcttccggcgcgttgagatcgatatgctcgatatcgtgacgcgacgtcatgatgctacttacggtgcgctggttgagattcagcacccgctcaatcatcctgcgctcctgcggattaaaaatctggctgtcgtcatggtctgccagcatcgcggcggtttccgcatccagttcggcatcctcttttttaccgctaatcagccgcatcacggcctccgttgtgcgctggcgcagcgtatggttagcggaaagaaaacggcggcggttaaaaatagccagttggttgagcgcctcgatcatcaccgagaagccgatagccgcgtacagataccctttcggaatgtggaaaccaaacccttccgccaccaggctaaagccgatcattagcaggaagctaaggcacaaaatgacaatggtgggatggttgttcacaaatcgggtcagggacttgctggcgagcagcatcaggctaatggcgattatcacggccgccatcatgaccgctaggtgatcgaccatccccacggcggtaatcacggagtcgagagaaaagatagcgtccagcaccactatttgcgcgaccaccgcccagaatttcgcccccttacgctgggtagggttggcgctatctttcccttccagccgttcgttgagctccatggtggctttaaagagcaggaagaagccgccgaacagcataatcagatcgcgggcgctaaagcttaacgcctgtacgctaaagagcggcttagtcaaggtgaccagccacgagattgacgccagcagcagcaggcgcatgatcatcgccagtatcaggccggtaatgcgcgcgcggtcgcgctgccccggcggtagtttttcagcgaggatggcaataaagaccaggttatcaatgccgagaacaagttcgataacgattaacgttaccagtccggcccagattgacggatcggcaatccattccatagtaagagcaataccttctgtaatatgacaattgtcacaattcgatcatggataatacggcggaaaaatgcaatgccgcagagcaatttatctttgttacggggctataaaataactttaaaatagccgtaatgtttctgtcggaaactaaataatgtcaagaatatatttaggaaatatcgcaggtggagtggagtaaataaatattgtcaacatcaataaaatcctaaaatcatctgttaattcatttaatattaatcttaaaaatatagaatggcgggtttgttaccttgcttgtcattaggttagctgcaacaattcttgcaggattaagatagcgcgcttaaatatcctgtcacgacatcgagaaaactattaatacgtaacctttatttcgctgaagatttttatctgaacgaggatgaaattggaggggaatgcgaaaatttagaataatcagtgtattggtagctaagaagctaggggcggtagcgtgcctgaaagcctgaatataagactttattattctgtcaatagcctgcggatgaattgatttttttcagaatgatgccagttaattttctctgccattaactgcaaggtaaatgtgcacggacgaagccgctatttaaattgcacaggataatgactctgccaaagtgataaataatcaatgatgaaatccaaaatgaaattgatgccattattggcgtcgctcagcttgataagtggttgcacagtactcccgggcagcaatatgtctacgatggggaaagatgtgatcaaacagcaagacgctgactttgatctcgaccggatggtcaatgtgtatccgctgacgccacggctggttgagcaattacgcccgcggcccaatgtcgcgcaaccgaatatgtcgctggaccaggagatcgccagctatcagtatcgcgtcgggcctggcgatgtgctgaatgtcaccgtctgggatcacccggaattgaccacgccagcaggccagtaccgtagctcaagcgataccggcaactgggctcagccggacggcaccatgttttatccctatattggcaaggttagcgtcgtcggtaaaactttgtcagagattcgcagcgatattaccgggcgtttagcgaagtacatcgcagacccgcaggtggatgtcaatatcgccgctttccgctcgcaaaaagcgtatatctccggccaggtgaataaatccggtcagcaggccattactaacgtcccgctaaccgtcctggatgcgattaacgctgcgggcggcctgaccgatatggcggactggcgcaacgtcgtgttgacgcacaacggcaaagaacagcgcatttcgctacaggcgctgatgcaaaatggcgatcttagtcagaaccgcttgctctaccctggcgacattctgtatgtgccgcgcaatgacgatctgaaagtctttgtcatgggcgaagtgaaaaaacagagcaccctcaaaatggatttcagcagcatgacgctcaccgaagcattaggcaatgcggaaggcatcgatctgaccacctccaacgccagcggcatttttgtgattcgtccgttgaaaggcgaggggggacgcggcggcaagatcgccaatatctaccagcttgatatgtctgacgccacgtcattggtgatggcgacggaattccgacttcagccttacgatgtggtgtacgtcacgaccgcgccggttgctcgctggaaccgtctgatcaatcagttgctgccgaccattagcggtgtccgttatatgacggatacggccagcgacattcattcctggtaatcgttatgtttaacaaaatcttagtggtctgtgtggggaatgtttgccgttccccgacggcggaacgtttgctaaagcgctttcatccttcgctgacggttgcgtctgccggattaggcgcgctggtcggcaaaggagccgatcctgcggcggcgagcgtggcgagcgcccacgatctgtctttggaaaatcactgcgcaaggcaaatttccgcgcgcctgtgccgggaatatgacctgattctgacgatggagaaacgccacatcgccgccctgtgcgacattgcgccggaaatgcgcagcaaggtaatgctgtttggtcactgggacagcgagcgtgaaataccagacccgtatcgcaaaagccgcgatgcgtttgaggcggtgtacacattactggaaaggtctgcccgccagtgggcgcaggcactgaatgcagagcagggaaaaccatgacagaaaaagtaaaacaatctgcggcggttacgggtagcgatgaaatcgatatcgggcgtctggtcggaacggtgattgaagcgcgttggtgggtgttggggacgacggccatatttgcgctgtgcgcggtaatttatacgttcttcgccacgcccatctatagcgccgatgcgctggtgcagattgaacaaaacgccggtaattcgctggtacaggatatcaacagcgcattagcgaataagccgccggcttccgatgcggaaattcagctcattcgatcgcgcctggtgctggggaagaccgttgacgatctggatctggatattgccgtcaccaaaaacacctttccgctgttcggcgccgggtgggagcggctgatgggacgtcacaatgaaatggtgaaagtcacgacattcacccgaccagagacgatgagcggacagatcttcaccctcaaagtgctgggcgacaaacgttatcagttggtcagcgacggcggatttagcgcgcagggcgttgtgggccagccactcaataaagacggcgtgacgatgcgggtagaggcgattgacgcccgtcctgatacggaatttacggtgagtaaattctcaacgcttggcatgattaataacctgcaaaataacctcaccgtaacggaaaccggcaaagataccggcgttctgaacctgacgttcacgggagaggatcgcgaccagatccgcgacattctcaacagtattacccgtaactatctgcaacaggatattgcgtggaaatctgaagaggcggggaagagcctggcgtttctggcaaaacaactgccggaagtccgcagccgtctggatgtggcggaaaacaagctaaacgctttccgccaggataaagactcggtggatttaccgctggaggcgaaggcggtgctcgattcgatggttaatatcgacgcccagttgaatgagttgacgtttaaagaagcggaaatttccaagctctttaccaaagcgcatccggcttaccgcaccctgctggaaaaacgtaaagggctggaagataaaaaagccaaactgaacgggcgggtgacggcgatgccgaaaacccagcaggagattgtgcgtttgacccgcgatgtggagtccggccagcaggtttatatgcaactgcttaataaacagcaggagctgaaaatcaccgaagccagcaccgttggcaacgtgcgcatcgttgacccggcgattacccagccgggcgtgctaaagccgaaaaaggcgttgattattctcggcagcattattctgggattaatgttatcgattgtcggcgtgctgctgcgctcgctgtttaatcgcggtatcgaaagcccgcaggcgctggaggagcacgggatcagcgtctatgccagtattccgctgtcggaatggcaaaaagcgcgcgatagcgtcaaaaccattaaagggattaagcgttacaagcagagccaactgctggcggtgggcaatccgaccgatctggcgattgaggcgattcgcagcctgcgcaccagcctccatttcgccatgatgcaggcgcaaaataatgtactcatgctcacaggcgtcagctcctctatcggtaaaacctttgtttgcgccaacctggcggccgtcatcagccagacgcataaacgggtattactgatcgactgcgatatgcgcaagggctacacccatgaactgctcggcaccaataacgtggacggcttatctgacattctggcgggcaaaggcgagatagcctcctgcgcgaaacccacggcgatcgctaattttgatcttattccgcgcggtcaggtaccgcctaatccatcggaattgctgatgagcgagcgcttcggcgagctgatcgcctgggcaagcagccgctacgacctggtattaatcgacacgccgccgattctggccgtgacggacgccgcgattgtgggtcgtcacgttgggacgacgctgatggtggcgcgttatgccgtcaacaccttgaaagaagtggaaaccagtctgagccgttttgaccagaatggcattcaggtcaaaggcgtcattctcaactccattttccgccgggcgacgggctaccaggattatggctattacgagtatgaataccagtcagattccaaataaaaaataaggcgtgccggatggcgcggcctgtgactgtaggccggacaagcgtagcgccatgcggcaaaactatctggggaataagcatgacaacagacaatccgctgatctcaatttatatgccaacctggaacaggcagcagttggctatccgggcgattaaatcagtactacgtcaggactaccgtcactgggagatgatcatcgtggatgattgctcctcgtcttatcagcagctacaacaatttgttgaggagctgaacgacccgcgcgttcgttatactcataacgccatgaataccggcgcctgcgcggttcgcaaccaggccattatgcaggcgcaaggacactacattaccgggattgatgatgacgatgaatggacgcccaaccgtctgagcgtgtttctggcccataaacaccagttgactacgcatgcctttttgtatgccaacgactatgtgtgcgagggcgaggtctactctcagcctgccagcctgccgctgtatccgaaatccccttattcgcgccgcttgttctacaagcgcaatattattggcaatcaggtttttacctgggcctggcgttttaaagcgtgtttgttcgataccgaactcaaggcggcgcaggattacgacatttttctgcgcatggtggtggagtatggcgaaccgtggaaagttgaagaggcgacgcaaattttacatatcaaccacggcgagatgcagattacctcttcgccgaaaaagttctccggctatttccatttttatcgtaagcacaaagataaattcgatcgcgccagcaaaaaataccagctttttacgctgtaccaaattcgcaataagcgaatgacctggcgcacgttgctgacgttgctctccgtgcgtaatagcaaacgcctggcggccgggctgcgggggcgataacgatgctggaagacttacgcgcgaatagctggagcttacgcccctgttgcatggtgctggcctaccgtatcgctcatttttgttccgtctggcgcaaaaagaatgtgctgaataatctgtgggccgcgccggtgctggtgctgtatcgcgtgatcacggaatgcctgttcgggtatgaaatccaggccgccgcgaccattggtcggcggttcactatccatcatggttacgcggtagtgatcaacaaacatgtcgtcgccggcgacgattttaccattcgccacggcgtcaccattggcaatcgcggcgcggacagcctggcttgtccggtgattggtcacggcgttgagctgggggcgaacgtcatcctgcttggcgatattactatcggtaatcacgtcacgattggcgcgggtagcgtggtgcttgacagtattccggatcatgcgctggtggtgggagaaaaagcacgggtgaaggtcagcacatgaatattctgcaatttaatgtacggctggcggaaggcggtgcggcgggagtggcgttagatcttcatctgcgggcgctgcaaaaagggctgacgtcgcattttgtttatggttatggcaaaggcggaaaaaaaagcgtcagtcaccaccgttatccgcaggtgataaaacagacgccgcgcggcacggcaatcgccaatatcgcgctatttcgtttcctgaatcgcgatctgtttggcaatctcgacaatctttaccgcacggttatccagacatccggcccgctggtgctgcattttcatgttctccacagttactggctaaacctggcggatatcgtgacgttttgcgaaaaagtcaaagcacaaaaaccggacgtcacgctggtctggacgctgcacgatcactggagcgttaccgggcgttgcgccttcaccgacggttgcgagggctggaaaagcggctgccaaaaatgtccgaccctaagcaattatccgccagtcagggtggatcgggcgcaccagcttattgacggcaaacgtcagcgctttcgtgacatgctgcggctgggctgccagtttatttcgccgagccagcatgtggccgaggtctttaacagcgtttatggcgcgggactctgccgggtgattaacaacggtatcgatctggcgaccgaggcgattctcgcgcaactatcacctgtgccgctgaatccgggcaaaccgcggatcgccattgtggcgcatgacttgcgttacgacggcaaaactgaccagcgtctggtacacgacatgatggcgctgggcgaaaaaattgaactgcataccttcggtaaattttcgccttttaccggccaaaacgtcgttaatcacggttttgaaaccgataagcgcaaattaatgagcgcgctcaatgagatggacgcgctggtctttagctcgcgggtcgataactatccgctgatcttgtgtgaagcgctctcgatcggcgtaccggtaatcgccacccacagcgaggcggcgcaggaggtgctggcgaaatccggcggccagacttttgccgctacagatgtactgcgcctggcgcagcggcgtaagccagagattgctcaggcggtattcggcgcaacgctggacgcctttcgtatgcgtagccgcgtcgcgtacagcggtcaacagatgctggaggagtatgtctcgttctatcagaatctgtagctatctgctgctgccgctgatctacctactggtcaatgtcaagattgcccaactgggggaaagctttcccattaccatcgtcacttttttaccgctgttgctgctgttatttgtggaacgcattagcgtaaaaaaattgatgatcgccttaggcatcggcgcggggcttacggcatttaacttcctgttcggccagtcgctgaatgccggtaaatatgtcacgtccacgatgctgtttgtctatattgtggtcattatcgggatggtctggagtatccgattcaaaaccatttccgcgcataaccaccgaaagattttgcgtttttttatctggtggtgggtatagtggtcgcgctcgccgcggttgagatggcgcaaattatccttaccggcggcagcagtatcatggaaggaatttcgaaatatctcatttacagtaatagctacgtactgaacttcataaaatttggcggtaagcgtaccactgcgctttattttgaaccggcatttttcgctttggcactaatctcaatttggctgagcatcaaacagtttggtatcaaaataccgaaaagcgatgctatgattctggcagggataatattatcaggatcattttcaggggtaatgacctttatcctgttttaccttctggagtgggcgttccaatatttgaataaggatgcgataaagaaaaaacttccactggcgctggtatcattaaccctgtttttggttggggtaattattgcatttccttatatcgcgacacgacttggcgatttagggacggaaggattatcttcttattatcgtattgtgggcccgttagtcatggtcggatattccttgacccatattgatggtgtagtcagatttggctcactttatgaatatgtcgcatcattcggaatctttaacggtgcggatgtcgggaaaaccatagacaatggattgtatctgctgattatttatttttcctggttcgcagtgctaatgacgctgtggtatatggggaaagttttaaaaatggcgctaaatgcgtttggcgataatcgcaattttcgggtgcagctctatctttttacgccggtgtcgctgttttttaccggttcaatatttagcccggaatatgcttttttaatcgtctgtccgttcattttgcgcaaggcgttaaaaatttcataacggggtggttgcatgtttttaagcgtcgttaccgtcgcctttcgcaattacgaaggggtggtaaaaacctggcgctcgctgcgcaatctggcgcgcgatccgggcctgtcatttgaatggatcgtagtggatggcggttcggaggacggcacgcgcgaatttctgcaaaaacgtcacggtgagtttaacctgcgttttatcagtgaaaaggatcgcggtatttatgatgccatgaacaaaggcattgccttggcgcaggggcgctataccctgtttcttaattccggtgatgcgttccatgatgatgccgcgctgtttgtccgccaactggcgcggcaaaagggcgaggcgatgtatattggcgacgcgctgctggatttcggcggcgggcataaaatacgccggaaagctaaacccgggtattatatctaccatagtttgccagccagccatcaggcgatatttttcccgacggcagcgttaaaaaagtatccttatgatctgcaatatcatgtctcttcagattatgcgctggcggcccgtctctataaagcaggctatccttttcggcgaattaacggactggtatctgaattttcgatgggcggcgtgtcaacctcgaataatctggaattatgtcaggatgcaaaaaacgtacagcgaaaaatattacgtgttccagggttttgggcgcaattatcctatttgttacgtctgaaaacgacgggtaaaacaaaagcgcggtataacaaagtctaatcaccgggagttattatgcaggatcttagcggctttacggtgccgaaagggttccgcggcgctaatgcgctaaaagtacaattatggtgggcggtacaggcgacattattcgccggatcgccgcaaatattgtatcgctggcgagcctttttgctgcgtctgtttggcgccaaaattggaaaaaatgtggttattcgaccgtcagtaaaaattacctatccgtggaaattaaccgtcggcgattatgcctggataggcgacgacgctgtgttatatacgttgggtgaaattaatattggcgcacatgcggttatttcacaaaaaggttatttatgtaccggtagccatgattataccagcgcccatttcgatattaacgccgcgccgattgttattggcgaaaaatgttggctggcgaccgatgtttttgtcgcgcccggcgtgacgataggtcatggcaccgtcgtcggcgcgcgtagcagcgtatttaaatcattaccggcaaatgcgatttgtcggggcaatcccgcagtggtaacgcgccagcgcgttcagaaagttactccctaacgggactatttgaggaaatgaaaatgtcaaaagtcgctctcattactggcgtaaccggacaggatgggtcttacctggcagaatttctgctggaaaaagggtatgaggtgcatggtatcaagcgtcgcgcgtcatcgtttaataccgagcgcgtggaccatatttatcaggacccgcacagctgcaacccgaaatttcatctgcattatggcgacctgaccgacgcctcaaacctgacccgcattttacaagaagtgcagccggatgaggtctacaacctgggcgcgatgagccacgtggcggtgtcgtttgagtcgccggaatataccgccgatgtggatgcgatgggcactctgcgcctgctggaggcgatccgcttcctcggtcttgaaaagaaaacgcgtttctaccaggcctccacctctgaactgtacgggctggtgcaggaaatcccgcagaaagagaccacgccgttctacccgcgttctccctatgcggtggcgaaactgtacgcctactggatcaccgtcaactaccgtgaatcctacggtatttacgcctgtaacggcattctgtttaaccacgagtctccgcgtcgtggcgaaaccttcgtcacccgtaagatcacccgcgccatcgccaatatcgcccagggactggagtcctgcctgtatctcggcaacatggactcgctgcgcgactggggccatgcgaaagattacgtacggatgcagtggatgatgttacagcaggagcagccggaagatttcgtgattgccaccggcgtgcagtattccgtacgccagtttgtggagctggcggcggcgcaactggggataaaactgcgctttgaaggcgaaggcattaatgagaaagggatcgtggtatccgttaccggacacgatgcgccgggcgtgaaaccgagggatgtgattgtggccgttgatccgtgttatttccgtccggcggaagtggaaaccctgctgggcgatccgtccaaagcgcatgagaaactgggctggaaaccggaaattaccctgtcggagatggtctccgagatggtggcgaacgatctggaggccgcgaaaaaacactcactgctgaaatctcacggttacgaggtggccatcgcgctggagtcctgagaatgaataagcaacgaatttttgtggcgggccatcgcgggatggtgggctccgccattgtacggcagcttgcgcagcgcggcgacgtggaactggtgctgcgcacccgcgatgagctggatctgctcgacgggcgcgcggtacaggcgttctttgccggagcgggtatcgaccaggtttatctggcggcggcgaaagtgggcggcattgttgccaacaacacgtatccggcggattttatttatgaaaacatgatgatagagagcaacattattcacgccgcgcacctgcacaacgtgaacaaactgctgtttctcggttcgtcctgtatctatccgaaactggcaaggcagccgatggcggaaagcgagctgctgcaggggacgctggagccgaccaacgagccgtatgccatcgccaagatcgccgggattaaactgtgcgagtcctacaaccggcagtacggtcgcgactaccgttcggtgatgccaaccaacctgtacggcccgcatgataatttccacccggacaattcacatgtgatcccggcgctgctgcgtcgctttcatgaggctgcgcagagccacgcgccggaggtggtggtgtggggcaacggcacgccgatgcgcgaatttctgcacgttgacgatatggcggcggccagcattcacgtgatggagctggcgcgcgaagtgtggcaggagaacaccgccccgatgctgtcgcacattaacgtcggcactggcgtggactgcaccattcgcgagctggcgcagaccatcgcaaaggtggtgggttaccagggccgggtggtgttcgacgccgcgaagccggacggcacgccgcgtaaattgctcgacgtcacgcgcctgcatcagcttggctggtatcacgaaatttcactggaggcagggcttgccggtacttaccagtggttccttgagaatcagcaacggttccgggggtgacaatgtttttacgtcaggaagatttcgccgccgtggtgcggaccacgcccctcatctccctcgatttcatcgtggaaaacggccagggggaaattttgctgggccagcgcctcaaccgtccggcgcagggctactggtttgtgccgggggggcgggtgtgcaaagacgaaacgctggaggccgcttttgcacgcctgacgcaggcggaactgggcgtgcgtctgccgctggcggcagggacgttttatggcgtctggcagcacttctatgacgacaacttttccagtgaggatttttcaactcactacatcgtgctcggctttcgtctgcgcgtggcggagagcgatttacgcctgcctgatgcccagcatggcagttaccgctggctgacgccggaacagcttctggcaggcgacaatgttcatgagaacagtcgggcctacttctctcctgacgcgccggcggtgggcctatgaagatcctggtctatggcattaactattcaccggaactgaccggtatcggcaaatataccggcgaaatggtggcgtggatggcgcgggaaggccatgaggtgcgggttattactgcgccgccgtactacccgcagtggaaggtcggtgagcgctattccgcctggcgctatcgccgggaagagggcgaggctaccgtctggcgctgcccgctgtatgtgccgaaacagccctccaccctaaaacgactgcttcatctggggagctttgcattgagcagttttttcccactgatggcgcagcgtcgctggaagccggatcggattatcggcgttgtaccgacgctcttttgtacgccgggaatgcgtctgctggcgacactctccggcgcgcgtaccgtactgcatattcaggattacgaagtggacgccatgctcggcttaggaatggcgggaaaaggcaagcgcggcagcgtagcgcggttagcgacggcctttgaacgcagcgcgctgcgtaacgttgataatgtttcgaccatctctcgctccatgatgaataaagcgcgggaaaagggcgtcgcggcggaaaaaatcctcttttttccaaactggtcggaagtggcgcgctttcaggacgttaatgacgctgacgtgacggctttgcgtcagcagcttggcttgccagagggcaaaaaaatcgtgctctattccggcaatatcggcgaaaaacaagggctggaaaaggtgattgacgccgcagaacgattacgcgatcgaccgttgatttttgcgattgtcggccaggggggcggcaaggcgcggctggagaacatggcccgcgaacgcggcctgctaaatattaaattcctcccgctgcagccttacgacgccttacccgcgctgctgaaaatgggcgactgccatctggtggtgcaaaagcgcggcgcagcggatgcggtactgccctccaagctgactaacattctggcggtcggcggtaatgcggtgattaccgctgagccgcacaccgaattaggacaactttgcgcgcgctatccgggcatcgccgtttgcgtggagccggagtcgaccgacgcgctggtcgacgggattagccaggcgctcgccatgccgaaaaacaacacgacggcacgtgaatacgccgaacgcacgctcaataaagagaacgtgctacgccaatttattgcagatattcggggatgataatgcgtcagacaaaactttacccggttgtgatggccggtggctccggtagccgattgtggccgctttctcgcgtgctttatccaaaacagtttttgtgcctgaaaggcgatctcaccatgttgcaaaccaccatttgccgtctgaacggcgtggagtgcgaaagcccggtggttatctgcaacgaacagcaccgttttatcgtcgccgaacagctccgccagctcaataagctgacggagaacattattcttgagcccgccgggcgcaataccgcgccggcgattgcgttggcggcgctggcagcgacgcgccagcatacggactgcgatccgctgatgctggtactggcggcggatcatgcgatcgccaatgaagaggccttccgcgacgcggtgcgcggcgccatgccctatgccgacgcgggcaaactggtgaccttcggtatcgtgccggatctgccggaaaccggctatggctatatccggcgcggtgatgtcgtgccgggcgcgacggatgcggtggcttttgaggtggcgcagttcgttgagaagccggggctggaaaccgcccaggcctacgtcgccagcggcgattactactggaacagcggcatgtttctattccgcgccggacgctatctggaagagctgaaaaagttccgccccgatattctggccgcctgtgaacaggcgatgcgcggcgtcgatccggatcttgacttcattcgcgtggatgaagaggccttcctcgcctgtccggaagagtccattgactacgcggtgatggagcggacggcggacgcggtggtgatgccaatggacgcgggctggagcgatgtcggctcgtggtcctcactgtgggaaatcagcgcccacaccccggagggaaacgtccaccacggcgacgtcatcagtcataaaacggaaaacagctacgtttacgccgaatccggcctggtgaccaccgtcggcgtgaaggatctggtggtggtgcagaccaaagacgccgtgctgattgccgatcgccacgcggtgcaggacgtgaaaaaggtggtggagaagatcaaggccgacggacgccatgagcaccacatgcaccgcgaggtttaccgtccgtggggcaaatacgactccatcgacgcgggcgagcgctatcaggtgaagcgcattaccgttaagccgggggaaggactgtcggtgcagatgcaccatcaccgtgccgagcactgggtggtggtggcggggaccgccagagtcaccatcaacggcgaggttaagctgctcggtgaaaacgagtccatctatattccgctgggggcgacccactgcctggaaaatccgggaaaaataccgctcgatttaattgaagtgcgttccggctcgtatctcgaagaggacgacgtggtgcggttcgaggaccgttacgggcgggtctgacgcctgcaattatgcccggtaagcgcaacgcgccatccggcaatgaataacaataacgatgttggccatttgcggtcagggctaactgttgcctgaagaagggtaagcacatgacaaaattaacctgtttcaaggcctacgacattcgcggcaggctgggcgaagagctcaatgaagatatcgcgtggcggattggccgcgcctatggcgaatatttaaaaccgaaaaccatcgtgctgggcggcgacgtgcgcctgaccagcgaggtgctgaagatggcgctggcaaaagggttacaggacgcgggcgtcgacgtgctggatatcggtatgtccggcaccgaagagatttacttcgccaccttccacctcggcgtggacggcggtattgaagtgaccgccagccataacccgatggactacaacggtatgaagctggtgcgcgagggcgcccgcccgataagcggcgacaccggtctgcgcgacgttcagcgcctggcggaagcgggcgacttcccgccggtcaacgacgccacgcgcggcagctacagacaaatcagcatgcgcgacgcctacatcgaccacctgctcggctacatcagtgttaacaatctcaccccgctgaagctggtgtttaacgccggcaacggcgcggcggggccggtcattgacgccattgaagcgcgcctgaaggcgctgggcgcgccggtggagttcatcaaaatccacaacaccccggacggcaccttcccgaaaggcattcccaacccgttgctgccggagtgtcgcgacgacacccgcaaggccgttattgaacacggggcggacatgggcatcgcctttgacggcgacttcgaccgctgcttcctgttcgatgagaaagggaagtttatcgaggggtactacatcgtcgggctgctggcggaagcgtttctggaaaaacacccgggggcgaagattatccacgacccgcgcctgacctggaacaccgaggcagtggtgacggcggcgggcgggacgccgatgatgtcaaaaaccgggcacgcctttatcaaggagcggatgcgtacggaggatgccatttatggcggggaaatgagcgcgcatcactatttccgtgattttgcctactgcgacagcgggatgatcccgtggctgctggtggcggaactggtatgcctgaaggggcagtcgctgggtgaactggttcgcgaccggatggcggcgttcccggcgagcggggaaatcaacagcagactggcggagccggcggcggccatcgcgcgggtggaagcgcacttcgcggaagaggcgcaggcagtggaccgcacggacggcctcagcatgtcgttcgccgactggcgtttcaacctgcgctcgtcgaacaccgaaccggtggtgcgcctgaatgtggaatcacgcggcgatattccgctgatggaagcgcgaacacgcactctgctggcgctgctgaatcagtaacgtcagatctccccttaccgcctgcgggtaaggggccaatcacaggaacaacgatgacaaatctaaaaaagcgcgaacgagccaaaaccaatgcatcgttaatctctatggtgcaacgcttttcagatatcaccatcatgtttggcgggctgtggttcatctgtgaagtcagtggactgccattcctgtacatgcacctgttggtggcgctgattacgctggttgtttttcaaatgctgggcgggatgaccgatttttatcgctcctggcgcggcgtcaaaatgtcgacagagttaacgctgttactgcaaaactggacgctgagcctgatcttcagcgccggtctggtggcgtttaatgatgactttgacaaccgcctcgccacctggttggcctggtatgcgctgtccagcctgggcttagtgttatgccgttcatttattcgtttcggcgcgggctggctacgcaatcgtggttataacactcgccggggcgccgtcgccggggatttgcctgcgggccaggcgttgctggatagcttccgtaatgagccgtggctgggttttgaggtggtgggcgtctatcacgatcctaaaccgggcggcgtctctgctgactgggccgggaacttcgaacagttaattgacgatgcgaaagcctcgcgaattcacaatgtttatatcgccatgtcaatgagcgacggcgccatggtgaaaaaactggtgcgcgagctggccgacaccacctgctcggtgatccttattcccgatgtgttcacctttaatattctccactcgcgcgtggaggagatgagcggcgttccggtcgttccgctgtatgacacgccgctatcagggattaaccgtctgcttaaacgggcagaagatatcgtgctggcgtcgctgattctgctgctcatctcaccggtactgtgctgcattgcgccggcggtcaaattgagctcgcccgggccggtgattttccgtcagacgcgctacgggatggacggcaagccgagcaaagtctggaggttccgctcaatgaaggtgatggagaacgataaggtcgttacccaggcgacgcaaaacgatccgcgcgtcacccgggtaggtaactttttgcgtcgtacctcgctggatgaattaccgcagtttatcaacgtattaaccggcgggatgtctatcgtcggtcctcgcccgcacgcggtggcgcataacgaacagtatcgtcagttgattgaaggttacatgctacgccacaagatgaagccgggcatcaccggctgggcgcaaattaatggctggcgcggtgagaccgatacgctggagaaaatggaaaaacgcgtggaattcgacctggaatacatccgcgaatggagtatttggttcgatatcaaaatcgtttttctgacgatttttaaagggtttgttaataaagcggcgtattaagaacctgacccacaaggctattttacttgccatattgcaccagggcagtgctcaatctggctgcgccaatgacgccttgtgaacaggttctggagaaaagaatgagtttacgacaaaaaacgatcagcggcgttaaatggtcggctatcgccacgatagtgattatcggtctggggttaattcagatgacggtgctggcgcggatcatcgacaaccaccagtttggcctgttgaccgtatcgctggtgattatcgcgctggccgacacgatttcggactttggcatcgcgaactcgattatccagcgtaaaacgattgggcatctggagctgaccacgctttactggctaaacgttgggcttgggattgtggtatttgcggtggtcttttggctgagcgatgcgattgcccatgttttgcataacccggatctcgcgccgttaatcaaaacgttgtcgctggcgttcatcgtgatccctcacgggcagcagttccgcgcgctgatgcaaaaagagctggagttcaataagatcggcatgatcgaaacgacctccgtgctggcggggttcacctttacggtgattagcgcccattactggccgctggcgttaaccgcgattctcggctatctggtgaacagcgcggtgcgaacgctgctgtttggttactttggccgcaagatttaccgtccggggctgcatttttcgctggcatcggtgtccacgaacctgcgttttggcgcgtggctgacggcggacagtatcgtcaattacatcaacacgaatttatcgacgctggtactggcgagaattctcggcgcaagcgtcgccgggggatataacctcgcgtacaacgtggctgttgtgccgccggcgaagcttaaccccatcattactcgcgtgctatttccggcattcgccaaaatccaggacgataccgagaagctgcgcgtcaacttctataagttgctttccgtggtgggaattatcaattttcccgcgctgttgggcctgatggtagtggcgaacaattttgtgccgttagtgtttggtgagaagtggaacagcattatcccgatcctgaaattgctgtgcgttgtggggctgctgcgctcagtcggcaacccgattggttcgctgctgatggcgaaagcgcgcgtggatatcagctttaagttcaacgtctttaaaacgtttctgtttatcccggcaattctcattggcggccatctggcgggggcgattggcgtgacgctggggttcctggtggtgcaaatcatcaacaccattctgagctatttcgtgatgattaagccggtactcggctccagctaccgtcagtatattctcagcctgtggctaccgttttatctctcattgcccacatttattaccagctacggcgcaggaaagctagtcgacggctatttaccgttgtcaggggtattcgcgctacaggttgtggtcggtattttgagttttattttaatgattattttttcacgcaatgcgctggtgatggaaattaaaaatcagcttgttggcagtgaaaaaatgaaaaagttattacgtgtcggatgacgaggatataagaggctatttatgaaattattaattttaggcaaccacacatgcggcaaccgtggtgatagcgccattatgcgcggtttgcttgatgccatccgtcaacaggcgccagaggcggagatggatgtgatgagccgtttcccggtgagttcctcctggttgcaggggcgaccgattattgccgacccgctgtatcaattaagccagaaacagcaggcggcggcagggcttaacggtcgggtgaaaaagtattacgccgtcgttttcagcataaaattttattgtctaaagtcgcccaggaaggatcgctgcgtaattttgctatcgcgccggaatttgccgaattcgcgcaatttattgcgcagtatgacgccgtcattcaggtgggcggttcaaactatgtcgacttatacggtttgactcactttgaatatccgctgtgcgcgtttatggcgaacaaaccaatttatatggtgggacatagcgtcggccctttccagaaccctgactttaactagctcgccaattatgttttgggcgcaccagtgcgctgatcctgcgtgaaaccgtcagccgcgatctgatgaccgccgcgcagatcgatacccgaaaagtagagcagggggtggataccgcctggttagtcgaacgccgtcacgacgagtttgtcgccagttatgctgtgcagcactggctggacgtcaccgcgcgccgcaaaaccgtcgcgattacgttgcgcgatctggagccgtttgataaacgcctgggcaccactcagcaggcctatgagcaggcatttgcccaggtcgtgaatcgcctgattgcggacggttatcaggtactggcgctgtcgacctgcaccagtatcgatcgctataaccgcgatgaccggatggttgcgttacggatggcgaagtatgtaaacgactcagagcatttccatatcgcgatggacgaactcaatgacgtggaaatcggaaagatcctcgcatcctgcgtactgaccatcgggacgcgcctgcattccgccattatctccatgaattttggcacgcccgctatcgccattaattatgaacataaatccgccgggattatgcagcagctaggcctggcggaattggccatcgatatccgtcacttgctgaacggttcattacaaagcgtggtggccgatacgctcaatcaattgcctgcgctaaaggcaaaagtggctaacgccgtcaccgaggagcgggcgaaagggttcacgatgatcaaatctgctctcgacagaattcgggaggcgcaatgaaagtcagcttttttctgctgaaatttccactctcatcggaaacctttgtgctgaatcagattactgcgtttattgatatgggccatgaggtggagattgtcgcgttacaaaaaggcgatacccaacatactcacgccgcctgggagaagtatggcctggcggcgaaaacccgctggttacaggatgagccccagggacggctggcgaagctgcgctaccgggcatgtaaaacgctgccggggctgcatcgggcggcgacctggaaagcgctcaattttacccgctacggcgatgaatcacgcaatttgatcctttccgcgatttgcgcgcaggcgggccaaccttttgtggcggatgtgttcatcgcgcactttggtccggcgggcgtgacggcggccaaactgcgcgaactgggcgtgcttcgcggcaaaatcgagactattttccacggaattgatatttccagtcgcgaggtgctcagtcattacacgccggagtatcagcagttgtttcgtcgtggcgatctgatgctgcccatcagcgatctgtgggccggtcgcctgaaaagtatgggctgtccgccggaaaagattgccgtttcgcgcatgggcgtcgacatgacgcgtttttcccatcgtccggtgaaagcgccagggatgccgctggagatgatttccgtcgcgcgcctgaccgagaaaaaaggcctgcatgtggcgattgaagcctgtcggcaactgaaagcgcagggcgtggcgtttcgctaccgcattctggggattggcccgtgggaacgtcggctgcgcacgctcattgagcagtatcagttagaggatgtcattgagatgccgggttttaaaccgagccatgaagtgaaggcgatgctggatgacgccgatgtttttttgctgccgtcgattaccggtacggatggcgatatggaaggtattccggtagcgctgatggagacgatggcggtggggattcccgtggtgtctaccgtgcatagcggtattccggaactggtggaggccggcaaatccggctggctggtaccggaaaacgatgcgcaggcgctggcggcccgactcgctgagttcagccggattgaccacgatacgctggggtcggtgatcatgcgcgctcgtgaaaaagtggcgcaagattttaatcagcaggcgattaatcgccagttagccagcctgctacaaaccatataaacgaggtggtatgcccgcgactaaattctcccgacgtaccctcctgacggcaggttccgcgcttgctgttcttccttttctgcgcgccttgccggtacaggcgcgtgaacctcgccagaccgtcgatattaaggattatccggcggatgacggtatcgcctcgttcaaacaggccttcgccgacgggcagactgtggtcgtgccgtcaggatgggtgtgtgaaaatatcaatgcggcgataacgattccggcgggaaaaacgctgcggatacagggcgcggtgcgtgggaatggccggggacggtttattttgctggacgggtgtcaggtggtgggggagcagggcggcagtctgcacaatgtgacgctggatgttcgcgggtcggactgtgtgattaaaggcgtgacgatgagcggctttggccccgtcgcgcaaattttcatcggcggtaaggaaccgcaggtgatgcgtaatctcattatcgatgacatcaccgttacccacgccaactacgccattctccgccagggatttcataaccaaatggacggcgcgcggattacgcatagtcgctttagcgatttgcagggggacgccattgagtggaatgtcgcgattcatgaccgcgacatcctgatttccgatcatgtcatcgaacgcattgattgtaccaatggcaaaatcaactgggggatcggcatcgggctggcgggtagcgcctatgacaatagttatcctgaagaccaggcagtaaaaaactttgtggtggccaatattaccggatctgattgccgacaactggtacacgtagaaaatggcaaacatttcgtcattcgcaatgtcaaagccaaaaacatcacgcccgatttcagtaaaaatgcgggtattgataacgcaacgatcgccatttatggctgtgataatttcgtcattgataatattgatatgacgaatagtgccgggatgctcatcggctatggcgtcgttaaaggaaaatacctgtcaattccgcaaaactttaaattaaacgctattcggttggataatcgccaggttgcttataaattacgcggcattcaaatttcctccggtaacgccccctcatttgttgccatcaccaatgtacggatgacgcgtgctacgctggaactgcataatcaaccgcagcacctctttttgcgtaatatcaacgtgatgcaaacttcagcgattggcccggcgttaaaaatgcattttgatttgcgtaaagatgtccgtggtcaatttatggcccgccaggacacgctgctttccctcgctaatgttcatgccatcaatgaaaacgggcagagttccgtggatatcgacaggattaatcaccaaaccgtgaatgtcgaagcagtgaatttttcgctgccgaagcggggagggtaagtaccgctatttttacgaaaattcctgggaaaaagttgttcatacttaatgttatggtgccgactaagacgtaatgtagagcgtgccatcattatccctggcagcagagtaattcatgctggcgaaaacaagctaaagagctataattcagcaaccattttacaggtggaagaaacaatgatgaatttgaaagcagttataccggtagcgggtttgggtatgcatatgttgcctgccaccaaggcaatcccaaaagagatgctaccgatcgtcgacaaaccgatgattcagtacattgtcgatgagattgtggctgcagggatcaaagaaatcgtgctggtgactcacgcgtctaaaaatgccgttgagaaccacttcgacacctcttatgaacttgaatcgcttcttgagcagcgcgttaagcgtcagcttctggcggaagtgcaatctatctgcccaccgggcgtgacgattatgaacgttcgccaggcgcagccgttaggactggggcactctattctgtgcgcgcgtccggttgtgggcgataaccctttcattgtggtactcccggatattattattgatgatgctaccgccgatccgctgcgctataaccttgcggcgatggtggcgcgtttcaatgaaacgggtcgcagccaggtgctggcaaagcgcatgaaaggtgatttatcggagtattccgttatccagacgaaagaacctctggataatgaaggcaaagtcagccggattgtggagtttatcgaaaaaccggatcagccgcagacgctggattccgatttgatggcggtaggccgttatgtgctttcagccgacatctgggcggaactggaaagaaccgaaccgggcgcctggggccgcatccagcttaccgatgcgattgctgaactggcgaaaaaacagtcggttgacgcgatgctaatgacgggcgacagctatgactgcggtaaaaaaatgggctacatgcaggcatttgtgaagtacgggctgcgcaacctgaaagaaggagcgaagttccgtaagagcatagagcagcttctgcatgaataagtattaacaaccgtgataaatggttggtgataaacataataacggcagtgaacattcgaagcggcaagttggctgaaacgagtgttgactgccgttttagttttgtataaagggcttaagtaacaaggggttatctggagcattttaatgctgattttataagattaatccttgtttccggatgcaattaataagacaattagcgtttaagttttagtgagctttgccctgctgggcgaggtttgtaacaagtcgatatgtacgcagtgcactggtagctgatgaaccaggggcggtagcgtgtgtaacgacttgagcaattaatttttattggcaaattaaataccacattaaatacgccttatggaatagaaaagtgaagatacttattactggcggggcaggttttattggatcagctgttgttcgccatattattaagaatacacaggacactgtagttaatattgataaattaacctacgccggtaatcttgaatccctttctgatatttctgaaagtaatcgctacaattttgaacacgcggatatttgtgattccgctgaaataacgcgtatttttgagcagtaccagccggacgcggtgatgcatttggctgcggaaagtcatgtggaccgttcgattaccgggccggcagcatttattgaaaccaatatcgtcggcacctatgtacttcttgaagttgcgcgtaaatactggtctgcgcttggcgaagataaaaaaaataattttcgttttcatcatatttccactgatgaagtttacggcgatttaccacatcctgatgaagttgaaaacagcgttacgttgccgttatttactgaaacgacggcatatgcgccaagtagcccctattctgcgtcaaaagcatccagcgatcatttagtccgtgcctggcggcgtacctatggtctaccaacgatcgttaccaattgttctaataactatggcccttatcacttccctgaaaaactgattccgttggtcattttgaacgcactggaaggaaagcctttgccaatttatggcaaaggggatcagattcgcgattggctatatgtagaagatcacgctcgcgcgcttcatatggtagtgactgaaggcaaggcaggggagacttataacattggtggccacaatgagaagaaaaatctcgatgtggtatttaccatctgtgatctgctggatgagattgtacccaaagcgacttcttatcgtgaacaaatcacttatgtcgcggatcgtccgggccatgatcgtcgttatgccattgatgcaggtaaaattagccgtgaattaggctggaaaccgctggagacctttgaaagcggtattcgtaaaacagtggaatggtaccttgcaaatactcaatgggtaaacaatgttaaaagtggggcgtatcagagttggatagaacagaactatgaaggacgccagtaatgaatatcttactttttggtaagacagggcaagtaggctgggagttgcaacgttctctggcgccagtggggaatctgattgccctggatgtccattcaaaagagttttgcggtgattttagtaatccgaaaggcgttgccgaaaccgttcgtaagcttcgtcccgatgtgattgttaacgcagcagcacatactgcagtagataaagcagagtctgaaccagaactggcgcagttgcttaacgccaccagtgtggaagccatcgctaaagcggccaacgaaattggcgcatgggtagtgcattattcaaccgattatgtatttcctggtaccggcgatatcccatggcaggaaacggacgctacgtcgccgctgaatgtctatggcaagaccaaactagcgggagaaaaggccctgcaggataactgccctaaatacctaatcttccgcaccagttgggtttatgcaggtaagggcaataatttcgcaaagacaatgcttcgtctggcgaaagagcgtcagacactttcagtcatcaacgatcagtacggtgcgccaaccggtgcggaattactggctgactgcacggctcatgcgatccgtgtgacattaaataaaccagaagtcgcaggtctttaccatctggttgccgggggaactacaacctggcatgactacgcggcgttagtctttgacgaggcgcgcaaagcagggataacgcttgcgctgactgagcttaatgctgtgccgaccagcgcctacccgacgccggcgagcagacctggtaattcgcgtctcaatactgaaaagtttcagcgtaattttggccttattctgccgcaatgggaattaggagttaagcgtatgctgactgaaatgtttacgacgacaaccatctgataaatttaaatgcccataagggcattttctatgaatgagaaatggaaatgaaaacgcgtaagggcattattttagcgggaggctccggcactcgtctttatccggtgaccatggcggtaagtaagcaattgctaccaatttatgataaaccgatgatttactatcccctttccacacttatgctggcaggcattcgggatatcctgatcatcagtacgccacaggacacgccgcgttttcaacaactgctgggagacggcagccaatgggggctgaatcttcaatataaagtacagccaagtccggatggcttagcacaggcgtttattattggtgaagagttcattggtaataatgattgtgcattagtgctgggtgacaatatcttctatggtcatgatttaccaaagttaatggaagctgccgttaataaagaaagtggtgctaccgtcttcgcttatcatgtaaacgatccagagcgctacggtgtggttgagtttgaccaaaatggcacagccgttagtctggaggaaaaaccgttacaaccgaagagtaattacgcggtaacggggctgtatttttatgataatagcgtggtggagatggcgaaaaatcttaagccttcctctcgcggtgagttagaaatcacggatattaaccgtatctatatggatcagggaagattgtctgtcgctatgatggggcgcggttatgcctggctggatacgggaacgcatcagagtttgatagaggccagtaattttattgcaaccatcgaagaacgccagggtctgaaagtgtcttgcccggaagagatcgcatttcgtaaaaattttataaatgcacaacaggttataaaactggccgggccattatcaaaaaatgattacggcaaatatttgctgaagatggtgaaaggtttataagtgatgattgtgattaaaacagcaataccagatgtcttgatcttagagcctaaagtttttggcgatgagaggggattcttttttgaaagttataaccagcagacctttgaagagtcgattggacgtaaagttacatttgttcaagataatcattcaaaatccaaaaagaatgtactcagagggctacattttcagagaggagaaaatgcacagggaaagttagttcgctgtgctgtcggtgaggtttttgatgttgcggtcgatatccgaaaagaatcacctacttttggtcagtgggttggcgtaaatctatctgctgagaataagcgacagctttggattccagaaggttttgctcatggttttgttactctcagtgattatgcagagtttctgtacaaagcaactaattattactcaccttcatcggaaggtagcattctatggaatgatgagacaataggtattgaatggcctttttctcagctgcctgagctttcagcaaaagatgctgcagcacctttactgcatcaagccttgttaacagagtaagcatcgtgtctcatattattaagatttttccatcaaatattgaattttccggtagagaggatgaatcaatcctcgatgctgcgctatcggctggcatccatcttgaacatagctgcaaagcgggtgattgtggtatctgtgagtccgatttgttagcgggagaagttgttgactccaaaggtaatatttttggacagggtgataaaatactaacctgctgctgtaaacctaaaaccgcccttgagctaaatgcgcatttttttcctgaactagctggacagacaaaaaaaattgtcccatgcaaggtaaatagtgctgtactggtttcaggcgatgttatgactttgaagttacgcacaccaccaacagcaaaaattggcttctttccagggcagtatatcaatttacattataaaggtgtaactcgcagttattctatcgctaatagtgatgagtcgaatggtattgagttgcatgtaaggaatgttcccaatggtcagatgagctcgctcatttttggggagttacaagaaaatactcttatgcgcattgaaggaccttgcggaacattttttattcgtgaaagtgacagacctataatcttccttgcaggcggtactggattcgctccagttaaatcaatggttgagcatctcattcagggaaaatgtcgtcgtgagatctacatctactggggaatgcaagatagtaaagatttttactctgcattaccgcagcagtggagtgaacagcacgacaacgttcattatatccctgttgtttctggtgatgacgccgaatgggggggaagaaagggatttgtccatcatgctgtgatggatgattttgattctctagagttcttcgatatatatgcatgtggttcacctgtgatgatcgatgccagtaaaaaggactttatgatgaaaaatctctctgtagaacatttctattctgatgcatttaccgcatctaaataatattgaggataatttatgaaagcggtcatcctggctggtggacttggtaccagattaagtgaagaaacaattgtaaaaccaaaaccgatggtagaaattggtggcaagcctattctttggcacattatgaaaatgtattctgtgcatggtatcaaggattttattatctgctgtggttataaaggatatgtgattaaagaatattttgcgaactacttccttcacatgtcagatgtaacattccatatggctgaaaaccgtatggaagttcaccataaacgtgttgaaccatggaatgtcacattggttgatacgggtgattcttcaatgactggtggtcgtctgaaacgtgttgctgaatacgtaaaagatgacgaggctttcctgtttacttatggtgatggcgttgccgaccttgatatcaaagcgactatcgatttccataaggctcacggtaagaaagcgaccttaacagctacttttccaccaggacgctttggcgcattagatatccaagctggtcaggtccggtcattccaggaaaagccgaaaggcgatggggcaatgatcaatggtggtttctttgtgttgaatccatcggttatcgatctcatcgataacgatgcaacaacctgggaacaagagccattaatgacattggcacaacagggggagttaatggcttttgaacacccaggtttctggcagccgatggataccctacgtgataaagtttacctcgaagggctgtgggaaaaaggtaaagctccgtggaaaacctgggagtaagtagatgattgataaaaatttttggcaaggtaaacgtgtattcgttaccggccatactggctttaaaggaagctggctttcgctatggctgactgaaatgggtgcaattgtaaaaggctatgcacttgatgcgccaactgttccaagtttatttgagatagtgcgtcttaatgatcttatggaatctcatattggcgacattcgtgattttgaaaagctgcgcagttctattgcagaatttaagccagaaattgttttccatatggcagcccagcctttagtgcgcctatcttatgaacagccaatcgaaacatactcaacaaatgttatgggtactgtccatctgcttgaagcagttaagcaagtaggtaacataaaggcagtcgtaaatatcaccagtgataagtgctacgacaatcgtgagtgggtgtggggctatcgtgagaacgaacccatgggagggtacgatccatactctaatagtaaaggttgtgcagaattagtcgcgtctgcattccggaactcattcttcaatcctgcaaattatgagcaacatggcgttggtttggcgtctgtgagggctggtaatgtcataggtggaggcgattgggctaaagaccgtttaattcccgatattctgcgctcatttgaaaataaccagcaggttattattcgaaacccatattctatccgtccctggcagcatgtactggagcctctttctggttacattgtggtggcgcaacgcttgtatacagaaggtgctaagttttctgaaggatggaatttcggcccgcgtgatgaagatgcgaagacggtcgaatttattgttgacaagatggttacgctttggggtgatgatgcaagctggttactggatggtgagaatcatcctcatgaggcacattacctgaaactggattgctctaaagcaaatatgcaattaggatggcatccgcgttggggattgactgaaacacttagtcgcatcgtaaaatggcataaagcatggattcgcggcgaagatatgttgatttgttcaaagcgtgaaatcagcgactatatgtctgcaactactcgttaagaaaataagtttaaggaatcaaagtaatgacagcaaataacctgcgtgagcaaatctctcagcttgtcgctcagtatgcgaatgaggcattgagcccgaaaccttttgttgcaggtgcaagcgttgtacctccttccgggaaggttattggtgccaaagagttacaattgatggttgaggcgtctcttgatggatggctaactactggtcgtttcaatgatgcctttgagaaaaaacttggggaatttattggagttcctcatgttttaacgactacatctggctcttcggcaaacttgctggcactgactgcgctgacttccccaaaattaggcgagcgtgctctcaaacctggtgatgaggttattactgtcgctgctggcttcccgactacagttaacccggcgatccagaatggtttaataccggtattcgtggatgttgatatcccgacatataatatcgatgcctctctcattgaagctgcagttactgagaaatcaaaagcgataatgatcgctcatacactcggtaatgcatttaacctgagtgaagttcgtcggattgccgataaatataacttatggttgattgaagactgctgtgatgcccttgggacgacttatgaaggccggatggtaggtacctttggtgacatcggaaccgttagtttttatccggctcaccatatcacaatgggtgaaggcggtgctgtattcaccaagtcaggtgaactgaagaaaattattgagtcgttccgtgactggggccgggattgttattgtgcgccaggatgcgataacacctgcggtaaacgttttggtcagcaattggggtcacttcctcaaggctatgatcacaaatatacttattcccacctcggatataatctcaaaatcacggacatgcaggcagcatgtggtctggctcagttagaacgcgtggaagagtttgtagagcagcgtaaagctaatttttcctatttgaaacaaggtttgcaatcttgcactgaattcctcgaattaccagaagcaacagagaaatcagatccatcctggtttggcttccctatcaccctgaaagaaactagcggtgttaaccgtgtcgaactggtgaaattccttgatgaagcaaaaatcggtacacgtttactgtttgctggaaatctgattcgccaaccgtattttgctaatgtgaaatatcgtgtagtgggtgagttgacaaataccgaccgtataatgaatcaaacgttctggattggtatttatccaggcttgactacagagcatttagattatgtagttagcaagtttgaagagttctttggtttgaatttctaatttttgagggggggggattcccctctatgatttcatgaaaattctaataatgggagcgtttgggttccttggatcacgacttacatcctacttcgaaagtcgacatactgtgattggcttagcaaggaagaggaacaatgaagctaccataaataatattatttacacgacagaaaataattggatcgaaaaaatactagaatttgaaccgaatattattattaacactattgcttgctatggaagacataacgaacctgcaacagctttaatagaaagcaatattcttatgcctatcagagtattagaatctatctcatcacttgatgcagtattcataaattgtggaacatcactgccaccaaatacgagtttatatgcatatactaaacaaaaagcaaatgaactcgccgccgccattatagataaagtttgcggtaaatatatagagttaaaattggagcatttctatggagcttttgatggagacgataagtttaccagtatggttattagacgttgtttaagtaaccagccagtaaagttaacatctggtttgcaacagagagatttcttgtatataaaagatctactaacagcgttcgattgtattataagtaatgttaataatttccccaaatttcatagtattgaagttggtagtggagaggcgatatcaattcgtgaatatgtagatactgttaaaaatatcacaaaaagcaattctataattgaatttggcgtggtcaaagaaagagtaaatgaattgatgtatagttgtgctgatatagcagaacttgaaaaaataggatggaaaagagagttctctcttgttgatgcattaactgaaataattgaagaggaagggaaatgaagcttttaattaccggtggatgtggcttccttgggagtaatcttgcctcctttgctttaagtcaagggattgatttaattgtattcgataatctatcacgtaaaggtgcaacagataatttacattggttatcctccttaggaaactttgagtttgtacatggtgatattcgcaacaaaaatgatgttacaagattaataactaagtatatgcctgatagctgttttcatcttgcaggtcaagtggcaatgactacatctattgacaatccttgtatggattttgaaattaatgtaggtggaactttaaatttacttgaggcagtacggcagtataattcaaattgtaatataatttattcatcaacaaataaagtatacggcgatcttgagcaatataaatacaatgaaacagaaactagatacacttgtgtagataagcctaatggatatgatgagagcacacaattagatttccactcaccatatggttgttcaaaaggtgctgcagaccaatacatgcttgattatgcaaggatttttggtttgaatacagtggtgttcaggcattcatcaatgtatggtgggagacagtttgctacttatgatcaaggctgggtaggttggttttgtcaaaaagcggttgaaattaaaaatggtattaataaacccttcactatttctggtaatggtaagcaagttagggatgttttgcatgctgaagatatgatttcgttatatttcactgccttggcaaatgtatcaaaaattagggggaacgcttttaatattggtggtaccattgtcaacagcctatcattacttgaattattcaaattgcttgaagattattgcaacatagatatgaggttcactaatttacctgtaagggaaagtgatcagcgtgtttttgttgcagatattaaaaaaatcactaatgcaattgactggagcccgaaagtctcggcaaaagatggtgtccagaaaatgtatgattggactagttctatatgatgtttctgcccgcgaaagcgggcataattaaagaatgaaatattttttataattaaaagatgaagctgacgtgaggaaactgaggttggttagaattccaagacatcttattattgccgcttcctcttggctttcaaagataataattgccggtgttcagttagtaagtgttaaatttcttttagaaattcttggcgaagaatcatacgctgtatttactcttttaactggattattggtctggtttagcattgcagatattgggattggtagtagtctacaaaattatatatctgagttgaaagctgatagaaaatcatatgatgcatatatcaaggccgcagttcatattctattcgcatccttaatcattttaagctctacattattcttcttatcagataaattatcgtcactatatcttacttcatttagcgatgaattgaaaaacaactcaggaagttatttttttatagcaagtatattatttatattcatcggcgttgggagtgtggtctataaaatattatttgcggaactgttagggtggaaagctaatataattaatgcattatcttatcttttaggttttttagatgtagttgcgatccattatttaatgccagattcgagtattaccttcgctttagtagcattgtatgctccggtagcaatactgcccattatatatatatcgtttcggtatatatatgttcttaaagcgaaagtaaactttaacacctataaattattactatcacgttcatcagggtttctgattttttcgtccttatcgataatagttttacaaactgattatattgtgatgtctcagaaattatctgctgcagatattataaaatatactgtaacgatgaaaatatttggtttaatgttttttatttatactgcggtattacaagcattatggccagtatgtgctgaattacgagtgaaaatgcagtggagaaagctgcatagaatcattttcctaaatattattggtggggtattttttattggtcttggtacgttatttatttatgttttaaaggattatatctatagcataattgctaacggtatagattataatattagtggggttgtttttgttttactggctgtgtattttagtataagagtttggtgtgatacatttgctatgttacttcaaagtatgaaccaattaaaaattctttggctcatagttccgtgtcaggcattaattggtggtgtgactcaatggtattttgcagagcattatggaatagttggtattttatacggactaattttatcgttctcgctaactgttttttggggattgccagtgtattatatgtataagagtaaaaggctagcataatatgaaggtatcattttgtatcccaacgtataatcgagtaaaattcattgaagaccttcttgaaagtattaataatcaatcttctcactccttaattgtagaagtatgtatttcagataatgcatcaactgatggaactgaagaatcaataaatatctggagagatagatttaattttccaattttatatcaaaggcataacgaaaatattgggccagataggaattatttatctgcagttaatatggggactggagattattgttggattttcggaagtgatgatattcttacaaaaaattcccttgcattgatggaagataaattggctgccggaagtgacatttatttatgtgacagacgagaattagatatttcaatgacgaaaatatctaatccacatcggcgatggttaaatggtggcagtagattattttcttttagcaatgaagctgatttgatagagtactttagtaaatgtaactcagtcggcggactttttagctacttaagctctattatagtgaaaaggaataaatggtctgacgtcttatttgacgagtcatacattggtacagcttatgcgcatgtatatattttattaagaataattaacaatatgaattcgaccctgcagtacatatcactgccactggttgattgcagaggagataacgatacattcgaaagtaatgggaaggctcgtcgaataaaaattgatttcatcggttatttaaaactgagggaggatttttataataacaatacaaaaatatatatctcatttggacgggttcttacaaaagagcgtccttggctttatacttctttagctatggcatgttatggtgattctaccgatagagctgaacttgcatcattttataagaagttgggatatccgaaaatagccaccaatttaatattttgtcttaaagggctggctagctacactaaaaaaataaaattagcaaaaatggtaataaaaaaaatattttcatagtatcaacatcaatacaaatcgagtttatagtgtaaaaaatgcttatgctattattgtcgtgactatttagcgtaaagtttatacgtgttttgtaggatgatttatttgcaatttccttaattagaacctttaaatactcttgctttttcggatacagtaacagatgctatatatgtatctataatatgtatggccggggttgtttttgactatttatcaatttcaaaattaagacttgtggcaattagagcttgtcggaaaccctacttttctttcttttgctcactatgctcttgcatatcttagtgtttaccatagagtgagtatattatgacagatgctattttttgtggcatttttacttggtataatatttggcttagtattatgaactgattttaatggtgattttataataattacaaggcttgcttatatttatttggatatgattccttattcatttttaattatgatccgtggttcattttaatgaaaatgtttcctaataactattggtcgttcttgtgataatcgctatacaagcatgaatggaaaaacggagagctattcaatgatcgttaacctatcacgtttaggtaaaagcggtacggggatgtggcaatactcgattaaatttttaacggctctgcgagaaatagctgatgttgacgcaataatctgtagcaaggtacacgctgattattttgaaaagctcggttatgcagtagttactgttccgaatattgttagcaacacatcaaaaacatcgcgacttagaccattagtatggtatgtatatagttactggcttgcgctgagggttttaattaagtttggtaataaaaaattggtgtgtactacgcatcacactattcccttactgagaaaccaaacgataaccatacatgatataagacctttttattatccagatagtcttattcagaaagtgtattttcgctttttattaaaaatgtctgttaagcgatgtaagcatgttttaacggtatcttataccgttaaagatagcattgctaaaacttataatgtagatagtgagaaaatatcagtaatttataacagcgttagtaaatctgattttatacaaaaaaaagaaaaagagaattactttttagctgttggagcaagttggccacataaaaatattcattcattcataaaaaataaaaaagtttggtctgactcttataatttaattattgtatgtggtcgtaccgactatgcaatgtctctccaacaaatggtcgttgatctgaaactaacagataaagtgacttttttacatgaagtctcatttaatgaattaaaagttttatattctaaagcctacgcgcttgtttatccatctattgatgagggttttggcatacctcctattgaagcgatggcatcaaatactccagttatagtgtccgatataccagtatttcatgaagtgttaaccaatggtgcattatatgtgaatccggatgatgaaaaaagctggcagagtgcaattgaaaatatagggcagttgcctgatgcaatttccagatttaacaactatgtcgcacggtatgactttgataatatgaagcagatggttggcaattggttggcggaatcaaaataaatgaaaataacattaattattcccacatataatgcagggtcactttggcctaatgttctggatgcgattaagcagcaaactatatatccggataaattgatcgttatagactcaggttctaaagatgaaacggttctgttagcctcagacctgaaaaatatatcaatatttaatattgactctaaagattttaatcatggaggaaccagaaacttagcagttacaaaaactctggacgctgatgttataatttttctaacacaagatgcaattctcgcggattcggatgcaattaaaaatttggtttattatttttcagatccattgatagcagcggtttgtggtagacaacttcctcataaagatgctaatccccttgcagtgcatgctaggaattttaattatagctcaaaatctattgttaaaagcaaggcagatatagaaaaatttggtattaaaactgtatttatgtccaattcttttgctgcctatcgccgttccgtttttgaagagttaagtgggtttcctgaacatacaattcttgccgaggatatgtttatggcggctaagatgattcaggcgggttataaggtcgcctactgcgctgaagcggtggtaaggcactcccataattataccccgcgagaagagtttcaacgatattttgatactggtgtatttcatgcttgttctccgtggattcagcgtgactttggcggagccggaggagagggtttccgattcgtaaaatcagagattcaattcctgcttaaaaatgcaccgttctggattccaagagctttattaacgacctttgctaaattcttgggttacaaattaggcaagcattggcaatctttaccgttgtctacatgtcgctattttagcatgtacaagagttattggaataatatccaatattcttcgtcaaaagagataaaataaatgtcttttcttcccgtaattatggctggcggcacaggtagccgtttatggccgctttcacgcgaatatcatccgaagcagtttttaagcgttgaaggtaaactatcaatgctgcaaaatactataaagcgattagcttcactttctacagaagaacccgttgtcatttgcaatgacagacaccgtttcttagtcgctgaacaactccgtgaaattgacaagttagcaaataatattattctcgaaccagtaggccgtaatactgcaccagcgatcgctcttgccgcgttttgtgcgctccagaatgctgataatgctgatcctcttttgttggttcttgctgcagatcatgtgatccaggatgaaatagcgtttacgaaagctgtcagacatgctgaagaatacgccgcaaatggtaagcttgtaacttttggtattgttccaacgcatgctgaaacgggttatggatatattcgtcgtggtgagttgataggaaatgacgcttatgcagtggctgaatttgtggagaaaccggatatcgataccgccagtgactatttcaaatcagggaaatattactggaatagcggtatgtttttatttcgtgcaagctcttatttaaacgaattgaagtacttatcacctgaaatttacaaagcttgtgaaaaggcggtaggacatataaatcccgatcttgattttattcgtattgataaagaagagtttatgtcatgcccgagtgattctatcgattatgcagttatggagcacacacagcatgccgtggtgataccaatgagtgctggctggtcggatgtgggatcctggtcctcactttgggatatatcgaataaagatcatcagagaaatgttttaaaaggagatatcttcgcacatgcttgtaatgataattacatttattccgaagatatgtttataagtgcgattggtgtaagcaatcttgtcattgttcaaacaacagacgctttactggtggctaataaagatacagtacaagatgttaaaaaaattgtcgattatttaaaacgaaatgataggaacgaatataaacaacatcaagaagttttccgctcttggggaaaatataatgtgattgatagcggcaaaaattacctcgtccgatgtatcactgttaagccgggtgagaaatttgtggcgcagatgcatcaccaccgggctgagcattggatagtattatccgggactgctcgtgttacaaagggagagcagatttatatggtttctgaaaatgaatcaacatttattcctccggatactattcacgcgctggaaaatcccggaatgatccccctgcagttaattgagattcaatcaggtacctatcttggtgaggatgatattattcgtttagaacaacgttctggattttcgaaggagtggactaatgaacgtagttaataatagccgtgatgttattcattcatcaggtattgtgtttggaacgagtggggctcgcggtcttgtaaaagattttacacctcaggtatgtgctgcttttacggtttcatttgttgccgttatgcaggaacatttttcctttgataccgtagcattggcaatagataatcgtccaagtagttatgggatggctcaggcgtgtgctgctgcattggcagataaaggcgttaactgtattttttatggtgtggtaccaaccccggctttggcctttcagtctatgtctgacaatatgcctgcgataatggttacgggaagtcatattccattcgagcggaacggcctcaagttttatcgtcctgatggtgaaatcacgaaacatgatgaggctgcgatccttagtgttgaagatacgtgcagccatttagagcttaaagaactcatagtttcagaaatggctgctgttaattatatatctcgttatacatctttattttctactccattcctgaaaaataagcgtattggtatttacgaacattcaagcgctgggcgtgatctttataagcctttatttattgcattgggggctgaagtcattagcttgggtagaagcgataactttgtacctatagatacagaggctgtaagcaaagaggatcgggaaaaagcacgctcatgggctaaagagttcgatttagatgccatattctcaacagatggggatggtgatcgtcctcttattgctgatgaggccggtcagtggttaagaggcgatatattaggtctattatgttcacttgcattgggggcagaagcggtcgctattcctgttagttgtaatagcataatttcttctggccgcttttttaaacatgttaaacttacgaaaattggctcgccttatgttatcgaagcttttaatgaattatctcggagttatagtcgtattgtcggttttgaagccaatggcggttttttattaggaagcgatatctgtattaacgagcagaatcttcatgccttaccaactcgtgatgctgtattaccagcaataatgctactttacaaaagtaggaatatcagcattagcgctttagtcaatgaactcccaactcgttacacccattctgacagattacagggaattacgactgataaaagtcaatccttaattagtatgggcagagaaaatctgagcaacctcttaagctatattggtttggagaatgaaggtgcaatttctacagatatgacagatggtatgcgaattaccttacgtgatggatgtattgtgcatttgcgcgcctctggtaatgcacctgagttacgctgctatgcagaagctaatttattaaatagagctcaggatcttgtaaatataacgcttgctaatattaaaaaacgatgcttgccgtaaaagaattgaatgttatttacttaatatgcctattttatttacattatgcacggtcagagggtgaggattaaatggataatattgataataagtataatccacagctatgtaaaatttttttggctatatcggatttgattttttttaatttagccttatggctttcattaggatgtgtctattttacttttgatcaagtacagcgatttattcctcaagaccaattagatacaagagttattactcattttattttgtcagtagtatgtgtcggttggttttggattcgtttgcgacattatacataccgcaagccattttggtatgagttaaaagaaatttttcgtacgatagttatttttgctatatttgatttggctctgatagcgtttacaaaatggcagttttcacgctatgtctgggtgttttgttggacttttgccataatcctggtgcctttttttcgcgcacttacaaagcatttattgaacaagctaggtatctggaagaaaaaaactatcatcctggggagcggacagaatgctcgtggtgcatattctgcgctgcaaagtgaggagatgatggggtttgatgttatcgctttttttgatacggatgcgtcagatgctgaaataaatatgttgccggtgataaaggacactgggactatttgggatttaaatcgtacaggtgatgtccattatatccttgcttatgaatacaccgagttggagaaaacacatttttggctacgtgaactttcaaaacatcattgtcgttctgttagtgtagtcccctcgtttagaggattgccattatataatactgatatgtcttttatctttagccatgaagttatgttattaaggatacaaaataacttggctaaaaggtcgtcccgttttctcaaacggacatttgatattgtttgttcaataataattcttataattgcatcaccacttatgatttatctgtggtataaagttactcgagatggtggtccggctatttatggtcaccagcgagtaggtcggcatggaaaactttttccatgctataaatttcgttctatggttatgaattctcaagaggtactaaaagaacttttggctaacgatcctattgccagggctgaatgggaaaaagattttaaactgaaaaatgatcctcgaatcacagctgtaggtcgatttatacgtaaaactagccttgatgagttgccacaactttttaatgtactaaaaggtgatatgagcctggttggaccacgacctatcgtttcggatgaactggagcgttattgtgatgatgttgattattatttgatggcaaagccgggcatgacaggtctatggcaagtgagtgggcgtaatgatgttgattatgacactcgtgtttattttgattcctggtatgttaaaaactggacgctttggaatgatattgccattctgtttaaaacagcgaaagttgttttgcggcgagatggtgcgtattaagcttaccgagaagtactgaataataattgtataaaatagcctgcgtaaaatctgaacgcatcaatcgctaccttaatatcatacctttgagttaacatactattcacctttaacctgccatgaccgtttgtggcagggtttccacacctgacaggagtatgtaatgtccaagcaacagatcggcgtcgtcggtatggcagtgatggggcgcaacctcgcgctcaacatcgaaagccgtggttataccgtctccgttttcaaccgctcccgtgaaaagaccgaagaagtgattgccgagaatcccggcaaaaagctggtgccttattacacggtgaaagagtttgttgaatccctcgaaacgcctcgtcgtatcctgttaatggtgaaagcgggtgcaggtactgatgcagctatcgattcgctgaaaccgtatctggaaaaaggcgatatcattattgatggcggtaacaccttcttccaggacacaatccgtcgcaatcgcgagctgtctgcggaaggttttaactttatcggtaccggtgtttccggtggtgaagagggcgcgctgaaagggccatctatcatgcctggcggtcagaaagatgcctatgaactggtggcgccgatcctgacgaagattgctgctgtggcagaagatggcgaaccgtgcgtgacctatatcggcgccgatggcgcgggtcactacgttaagatggtccacaatggtattgaatatggcgatatgcagcttatcgctgaagcttactccttgctgaaaggcggcctgaatctcagcaatgaagagttggcgaacacttttactgagtggaataacggcgagctgagcagttatctgatcgacatcactaaagacatcttcactaaaaaagatgaagacggtaattacttgatagatgttattcttgatgaagccgccaacaaagggaccggtaaatggaccagccagagcgcgctggatctgggcgaaccgctgtcgctgattaccgaatccgtctttgcgcgttacatctcttcgctgaaagcgcaacgtgttgccgcatctaaagtgctctccgggccgaaagcgcagccggcgggcgacaaagcggaatttatcgagaaagtgcgtcgcgcgctgtatcttggcaagatcgtctcctatgcgcagggcttctcgcagctacgcgccgcgtctgatgaatatcactgggagcttaactacggcgagattgctaagattttccgtgcgggctgtatcattcgcgctcagttcctgcagaagatcaccgatgcttacgcagaaaacgccggtatcgctaacttgctgttagcgccttacttcaagaaaattgctgatgagtaccagcaggcgctgcgtgatgttgtggcttacgcggtgcagaatggcattccggtgccgacattctctgcggcagtggcctactatgacagctatcgcgccgcagtactgccagctaacttaattcaggcgcagcgtgactactttggtgcgcacacctataaacgtactgataaagaaggcattttccataccgagtggttggaataatttctgcaagcttgtttaagcccggtttaatactgggcttttttttatctctattcttattgatttatcgcttttgcttaatattaacttaataatctgtgtttatcgtaatgaagataatctgaattgttttcgtctgcgttgcactttatatactcaggcgttaaaactttgatatcttatcaggatgcgaaatacatcatgattcataattaagttaattctgagagcgaataatgaaaatcacgatatccgggacgggttatgttggcttgtctaatggtttgcttattgcacaacaccatgatgtggtggcgttagacattgttcctgcccgtgttgaactgttaaatgatcggatatctccgattgttgataaagaaattcagcaatttttaaaggaagataacatcagattcagggcaacgctggataagtttgatgcataccagaatgcagattacgtcatcattgctacgcctacagattacgatccaaaaaccaactattttaatacgttcagtgtagaatcggtcattcaggatgtgatcagcatcaaccccgcagccgtgatgattattaagtctacggtgccggttggctttacggcggcaatgcgtcagaagtttgcgacagaaaatatcattttctctccggaatttttacgtgaaggtaaagccctttacgataacctttatccctcccgtatcgtgattggggaacagtctgagcgcgcccgagaatttgccgcattactccaggaaggcgctattaaacaggagattccgacgctgtttacggactccactgaagcggaagccattaaacttttcgccaatacttacctcgccatgcgagtcgcttattttaatgaattagacagttatgctgaaacgttaggattaaatacccgacaaattattgaaggggtgtgcctcgacccgcgtattggcaatcattacaataatccctcttttggttatggcggatattgtttgccaaaagataccaaacagttgctggctaattatcagtcagtgcctaataatattatctccgctatcgttgaagcaaaccgtacgcgtaaagattttattgccgattctatccttgccagaaagcctaaagtggtgggcatttatcgcctgattatgaagagtggctccgataacttccgcgcctcatcgattcaggggattatgaaacgtattaaagcgaaaggcgtagaggtcatcatctatgagccggtaatgcaagaagaaactttctttaactcacgtcttgaacgtgatttgcactgctttaaacagcaggcggatgtcattatttccaatcggatggcggcagagcttttggatgtcgctgaaaaagtgtatacccgcgatcttttcggtagtgattaataaggcaatcggggctgatgagtcccgatgatttattgaccaaatggaaataatgtctgatttttatcattaatcctatggcatatattttctttatgactacactgtctccagcttcatcctttttttagttagggtatctatgacagtggatagtaatgcgtcttccgggcgtgggaacgatccggaacagattgatttgattgagttattgctacagttatggcgtgggaagatgaccattattgtagccgttattatcgccattttgctggccgtaggctacctgatgatagccaaagaaaaatggacatccacggcgattattacccaacctgatgccgcgcaggttgccacctataccaacgcgctcaacgtcttgtatggcgggaatgcccccaaaatctctgaagtgcaggcgaattttataagccgctttagttctgcgttttccgcattatcggaagcgctggataatcagaaagagcgggaaaagctcaccattgaacagtcggtaaaggggcagacgctgccgctctcggtttcttatgtgagcactaccgctgaaggggcgcagcgtcggctggcggaatatatccaacaggtggatgaagaggtcgctaaggaactggaagttgacctgaaagataacatcacgctgcaaaccaaaacgttgcaggagtcccttgagacgcaggaagttgtggcgcaggagcaaaaagatctgcgtattaagcaaatcgaagaagcgttgcgctatgcggatgaggccaaaatcacgcagccgcagattcagcaaacccaggatgttacccaggacacgatgttcctgttggggagcgatgcgctaaaatcgatgatacagaacgaagcgacgcgtccactggtcttttctccggcctattaccagacgaagcagacactgctggacattaaaaatctgaaagtgactgccgatacggtgcacgtctatcgttatgtgatgaagccgacgctgccggtccgtcgcgatagcccgaaaacagccattaccctcgtgctggctgtgttgctgggcgggatgatcggcgccgggattgtgctggggcgcaatgcgctacgtagctataagccaaaagccttgtaagcttctttgccggatggtggtcggcttcgaaaggtaaaatttctcattaaaaaaccgggcattgcccggtttttttacgcttattgatgacgcttacgaagatcgtcgatcacggtggtgaggttgagatcctgatcctgcaacagcaccagcaggtggtacatcaaatcagacgcttcattggttaattcaaaacgatcattgacggtggccgccagcgcggtttctacaccttcttcgccaactttttgcgcaatacgtttggtaccgctggcgtacagtttcgccgtgtaagagctggccggatcggcggttttgcgctctgccagtagctgctccagttgatacaggaataaccactgatggctggcgtcgccaaagcagctgctggtacctttgtggcaggtcggcccgacagggtttgccagcaccagcagtgtatcgttgtcgcaatctggcgcaatgctgacgacattcagcacatggcctgaggtttcgcctttggtccataaacgctgtttcgtgcgtgagaagaacgtgacatggccggattcaatggttttgtccagcgcttgtgggttcatatagcccagcgtcaatacttcgccggataccgcatgttgcacgatggctggcatcaggccatcggttttttcccagtccagctcgcggcgttgttgctctgttaacatatcctgatctccacgccctggcctgccaggtacgcttttaattcgccaatattgatgatttgcttgtgaaaaacggaggcggcaagcgcgccgtcgacatcggcatcacggaatgcctcaagaaagtgttccatcgtgcccgcgccgccggaggcgatcagcggcacgcggcaaacgtcacggacttttttcaactgcgtcagatcataaccgttacgcacgccgtcctggttcatcatattcaggacgatttcccccgcgccgcgctgttgtacctcttgcacccagtccagcgtctcccactgcgtcacgcgggtacggttttcatcgccggtatactggttaacatgatatttccccgtggcgtcgtcaaaccaggtatcaatcccgacgacaatgcactgcacgccaaaacggtcagccagacgggtaatcagcgttgggtcagccagtgcaggggagttgatagagatcttatccgccccgaaagagagaattttggcggcgtcgtcaattgaccggataccgcccgctacacaaaacggaatgtcgatcacctcggcaacgcgcgctacccagcttttatcgactacgcgaccatcgctggaggcggtaatgtcatagaacaccagttcgtccgcgccttcgtcggcatagcgtttggccagcggaacgatatcgccaatgatctcatggttgcgaaactgtacgccttttaccacctgaccatcacgaacgtccagacacggaattatacgttttgccagcattggatggcctccttaacggtaaatttcccttccaacagcgcgcgtccgacaatcacgccgcgcacgccggtgccgcgcagggcggcaatatcatcgatatcgccaataccgccggaggattgaaaggcgatctgcggatatctggcgcatatctcttcgtacagtgaaacgttagagcccgccagcgtgccgtcgcgagaaatatcggtacacagtacatgtttcaggccgacggggagataggtctccaccagttgttccagcgagacgccggaattttcctgccagccgctaaccgccacctgcttgttgccgtgttcgtctatgcgaacgtccagcgccagtaccagcgcctgcgcgccaaaacgttcaaaccagcctttcaccacgtcaggggatttcaccgccgttgaaccgatgaccacacgggcaacgccagctttcagtaatgccgcaacgtcttcttcggtacgcacgccgccgccgacctgaacaggcacgttcacgcccgcgaccagagttttaatcagcggtatctgtcgcttagccggatctttagcgccggtcagatctaccagatgtagcaccccggcgccctgggcggcgtaatcctgcaaacggggcaggggatcgttaccgtaatcccgctgccgggcgtagtcgccctggtggagacgcaccacggtgccgtcaattaaatctaatgccggaataatcattacatctccaggaagtttttcagcaactgtgcacccgccgcgcccgaacgttccggatggaactgtacgccgaagaaattatctttctgtaccgccgcggtaaacggctcgccgtaattgcactgggcgatagtccacgggttgaccggcatcgcgtagctgtgaacaaagtaaaaataggcgccatcttcaatgccctgaaacagccggttgcccgcctgcggatacacgcgattccagcccatgtgtggcagcggcagaccaaagtcggtcattttcggcacatcttgttcgataatgttcagcagatccacgccgcgtgtctcttcgctgcgacgacccagcagttgcatccctaagcagatacccagtaccggctgagtacacgctttaattaagtcgatcagttcacgttcgcgcagttgatccatagcggcttgcgccgtgccgacgccgggcagaaagagtttgtcagcgcgtaatacgatttccgcttcgcggctgaccaccggggtgtaaccgtggcgcgccacggcggattttaccgagcttaaattggcgcagccggtgtcaaggatgacgacgttcatcacagcactcctttcgaggacggtaatgtatcgccctccacgcgaatagcctggcgtagcgtccgaccaaaggctttaaacaaactttcgacacggtggtgatcgttcttacctttagtcttgagatgcagagtgacgcccatcgtgtaagagagtgagcggaaaaagtgttcaatcatctctgtgctcaaatcgcccacacgctggtaggtaaattcagctttatattccagatgcggacgaccggaaatatccagcgcgcagcgcgccagacattcatccatcggtagtacaaagccaaaacggcagataccgcgcttgtcgccgagtgccagttttaacgcctcaccgagcgccagcccggtatcttctaccgtgtggtgatcgtcgatatagagatcgcccttaacggtaatctccatgcgaaagccgccgtgggtggcgatttgatcgagcatatggtcaaagaagccgacgccggtattaatcttgctgttgccttcgcgatccagccagacgctgacatcaatctgtgtctctttggtgttgcggaccacatgcgcatagcgatcgcgtttcgttagctgttcgccaatcatcgtccagttcaacgtttcacggtgatagcgtaaaccagtaatgcccatattatcagcgagttggatatcggttgcacgatcgccaatcacatagctgttggcgctatccatcgcttgttccgcaagataacgctccaccagcttcactttgggcttgcggcagtcgcagtcgtctgcgggcaggtgagggcagatcagcacctcatcaaagcatacgccctgagaagtgaaaatctgcatcatcaggttgtgcggtccgtcgaagtccgcctgcgggaagctttgcgtgccaagtccatcctggttagtgatcatcaccagcttaaaaccggctttttgcagcttcagcaatacgggaatcacctctggctcaaaggccagtttatcaaagtggtctacctgaaaatcgctcggcggttcggaaattaaggttccgtcccggtcgatgaaaagatacttctgactcatactggctccgcacgtaaggcgtcaatgacgcgctggttttcctggcgggtgccgaccgtaatccgcaggcagccgcttaaagaaggttgtttattctgatcgcgtaagataatgccctgatcccataaggatttaaacacgctgctggaggcggtaaaccgcgccagaatatagttggtttcagagtcaaagacgtgttctacgcaggcggtctgttgcagggcattcaccagatactgacgttcctgcactgtctgcgccacgcgatcgcgcattacgtttattccctgcgggctcagcgcttgggcggcgatatccgccactggcgtagaaagcggataaggggcgatcacttttaacagcaggttgatcacctcttcattagccagcgtaaagccgcagcgcagacccgccagcgcaaaagctttcgacaatgtgcgcaggataaccagatgaggatatttaaccagccagcctgccagcgtggcctgcgggcaaaactcaatataagcttcgtcggcgacgactatcgctttaccgcgtgtcaactccagcagcgtgcgcagatcctgcgggttgataagttgcccggtaggattattggggctacaaacgaacaccacttttgcgccgtcaaggttgtcggaaatcccctgtagatccagctgccagttttcaagcgcgggaaccgtccggcgctctacgccaatggtttcggcgctgacgctgtacataccgtaagtgggcggacagtagagaatggcgtctttccccggttcgcagaaggcgcggatcaccagttcgatcccttcatccgcgccgcggctgaccagcacctgctccggctttacgccagcatattgcgcgtagttttcaatcacggcctttggctggcattccgggtagcggttaagcgtttgttgggtgagctgaaactccaccgctgtcgggaattcattcgcgttcagccagacatcgccgttaccgcccagacggcgggcggactgatacggtaccaggttgcggacattttcacgggctaagtctgcgacgctgagagtgttttcagtgctcatgcttgctccttgagggcgtttacgcgcagggtcacggcatttttatgggcggtcagacgttctgccgccgccaatgtttcaatggttgatgccagagcggaaaagcccgctttcgacagttcctgaacggtcatccgtttctggaaatccgctaacccaaggctggaacaggtagcagtatagccataggtcggtaaaacatggttggttccggaagcgtaatcaccggcggattccggcgaccagtcgccgagaaataccgagcctgcgctggtaatcgcatccaccaaatcgcgcgcattgcgcgtctggataattaagtgttccggcccatactgattagagatggcgacgcactgcgctaaatctttggtcacaatcagacgactggcgctcagggcctgccgggcggtgcccgcgcgcggcagttccgccagttgacgttctaccgcctccgccaccttgcgggcaatgtcagcatccggcgtcagcaggatcacctgggaatccgggccgtgctcagcctgggagagcaggtcagaagcgacgaaatccggtgttgcgccgctgtcggcgatcaccagcacttcagacggcccggctggcatatcgatagccgcgccgtcgagacgctggctgacctgacgcttggcttcggttacaaaggcgttgccggggccaaaaattttatccactttcggtacggactcgctgccgaaggccagagcggcaatcgcctgcgcgccgccgacgttaaagatttcctgcacgccacacagttgcgccgcatagaggatttcatcagcgatgggtggcggcgagcacagaaccaccttctggcatcccgcaatgcgcgccggcgtcgccagcatcagcaccgttgagaagagcggagccgagccgccgggaatatacagaccgacagacgcgacgggacgcgtaacctgctggcaacgcacgcctggctgggtttccacatctacaggcggtagcgtctgcgcggaatggaacgtttcaatatttttgacggcagcggccatcgcctgttttaattcgtcgctcagacgcgcgccggcggcggcgatctcttcaggggtgacgcgtagcgctgtcacttctgttttatcaaatttagcgctgtattcacgcagggcatcgtcaccgcgcgtttttacattatacagaatatcgctgaccgtccgggtaatactgtcagaggcggaaatcgccggacgcgtcagcagcgcacgctgctgttcagggctacagctgttccagtcaatcagggtattgaagctcatggtctttactccatcacagggttccgccttatccggcctactgaacccaaaatatcaacgcattacgtaggcctgataagcgcagcgccatcaggcgtcagatcactccatcatcttctcgatcggcagtaccagaatcgagctggcgccaagcgctttcagtttctccatggtttcccagaacaacgtttcgctgctgaccatgtgcatcgccacgcgctgttgctcgcctgccagcggcagaattgtcggcctttcggcgcctggcagcagggcgataacctcttccagtcgttcacttggcgcgtgcatcatgatgtatttcgattcgcgcgcctgaatcacgccctgaatacgggtcagcaatttatcgatcagctgttgcttgctctgtgccatctcaccgtcgcgctgaatcagacaggctttagagcggtagataacttcgacttcacgcaggccgttagcttcaagcgtcgcgccggtagagaccaaatcgcagatagcgtcggccagccccgcgcgcggcgcgacttcgacagaaccatttaacagacacgatttaaaagagacgcctttctggtcgaggtagcgtttgaggaggtgcggataagaggtagcgatacgtttaccgtccagcgcggccgggccgtcccaggcttcgtcaaccggcgttgccagcgataaacggcagccgccgaagtcaagacggcgcagggttaaatagcgtggatcttcgccctgcgcgcggcggttgagtagctcttcttccagcacgttttcgccgataataccgagatcgaccacgccatccatcaccagacccggaatgtcatcatcacgcacgcgcaggatatcaatcggcatgttttccgccatcgcaatcaggcgctgagtgtgtaaattaatttttatgccgcagcgggccagcaattctcgtgaatcatcgcttaaacggcctgatttctgaatagctatgcgtaagcgggtgttgtctaacattctgcgttcctctttatcctgtctgaaccggtctgtatcgcgcgccaaaaaaaaagcccccggaagatgatcttccgggggctttctcatgcgttcatgcaccactggaagatctgaatgtcttccagcacacatcgcctgaaagactagtcaggatgatggtgatgtttaaattgaacgcgtgtcataaaaattccgatgaatgcttattcatttgataccttttaacctaaaccacttttacgccttaaagcaagcgcttttttcatttcgcatttatagtatgaattgtcagtcacggcgggctggcgtagccttatgtataaggcgttaaagtcaggagaaaatggatgaaaaaggtcgcaattgtcggtttaggttggttaggcatgccgctggcaatgtcgctggcagcgagaggctggcaggttaccggcagcaaaaccacccttgacggggtggaagcggcccgtatgagtggaattgaaagctatccgctgcgtctggagccggagctggtctgtgaggcggacgatcttgacgctctgctggatgtcgatgcgctggtgataacactgcccgcgcgccgtagcggtccgggagaggatttttatctgcaggcgatgcaggagctggtcgacagtgcgctggcttatcgtatcccgcgtattatttttaccagttcgacgtctgtttacggcgatgcgcaaggcgtggtgaaagagaatacgccgcgtaatccggtcacggccagcgggcgtaccctgaaggaactggaagattggctgcataatctgccgggcacgtcagtggatattctgcggctggcggggttagtcgggcctgggcgccatcccggacgtttctttgccggaaaaaccgcgccggatggtcaacacggggtcaatctggtgcatcttgaagacgtggttggcgcaattacccttttgctacaggcgccaaaaggggggcacatctataatatatgtgcgccggcgcatccagcccgcaacgtgttttatccgcaaatgacgcgcttgctgggaatggcgccgccgcattttcgtgacgcaccggacaacggcaaagggaagattatcgacggtagccggatttgtaatgagctgggatttgaatatcaatatcccgatccgttggtgatgccgatggagtgagtcgctgtccagcaggtggtcgccatatagcgcaaggggacgagtatgaaaccactgctggacgttctgattattcttgatgcgttagaaaaagaaggcagcttcgcggcggcgtcggcaaaattatttaaaacgccgtccgccctcagttataccgttcataagctggaaaacgatcttaatatccaactgctcgaccgtagcgggcatcgcgcgcgatttacgcgaaccggtaagatgctactggaaaaaggccgtgaagtgttgcacaccgttcgcgagctggaaaagcaggcgattaaactgcatgaaggctgggagaacgaactggtcatcggtgtggatgatacctttcccttttctcttctggccccgcttatcgacgctttttatcaacgccacagcgtgacgcgccttaaatttgtcaatggcgttctcggcggttcatgggagacgctgacgcagggaagggcggatattattgttggcgccatgcgcgcgccgccgcctgacaccggctttggctttgcaagactgggcgatcttgaactggtgtttgctgtcgccccgcatcatccgctggttcatgaagaggaaccgcttagccgccagacgatcaaacgttttcgcgcgattgtggttggcgatagcgtccattcctcgcgatcaatagggtctgaactgctcgacgctcaggaagcgattaccgtgtttgattttaaaaccaagctggagctgcaaattagcggcctgggatgcggctatttaccgcgttatctggcgcagcgatttttggaaagcggcgcgcttatagagaagaaagttgtggcgcaaatcgtctatgaaccggtgtgggttggctggaatgaacagaccgccgggctggccagcggctggtggcgggatgaaattttagcaaataatgctattgctggggtgtatgcaaaatcgccggtttaaaaatcaatcgcttatgaaaaataattttttgaacgcgctcgcattctcttgtcatttcacttcaatttagggcagaatatgccgcttgcaaaaaatgacactaaccgacgttttaatacgcgtcggttatttttttgcttcaaacacatcattcaataccaagaggccgggcttcgtaccggatagatacttacttaaaaatcgacagttgttgtcgctgaggaatccagaaaatggggcaattttttgcttacgcgacggcattcgccgtaaaggagaatgaccatgtcgcataacgttactccaaacacctctcgcgtggaattacgtaaaacgcttacgttagttccggttgtaatgatgggtcttgcctatatgcagccgatgacgctgttcgatacatttggtatcgtttcaggcctcactgacggtcacgtaccgacggcgtatgcattcgcgttaatcgcgattctgtttacggcgttgagctacgggaaactggtgcgtcgctatccttccgcgggttcggcgtacacctatgcccagaaatccatcagcccgaccgttggctttatggtgggttggtcttctctgctcgattatctgttcgcgccgatgatcaacattctgttggcgaaaatttattttgaagcgctggtgccctccattccctcatgggtgttcgtcgtggcgctggtggcctttatgacggcctttaacctgcgcagcctcaaatcggtcgctaacttcaacactgtgattgtggtgctacaggtggtgctgattgcggtcattctgggcatggtggtttatggcgtatttgaaggcgaaggcgccggtacgctggcgagcacccgtccgttctggtccggcgatgcgcacgttatcccgatgattacgggagcgacgatcctgtgcttctcctttaccggctttgacggcatcagtaacctgtcggaagagaccaaagatgctgagcgcgtgatcccgcgtgcgattttcctgaccgcgctgattggcggcctaatcttcatctttgcaacctatttcctgcaattgtacttcccggatatctctcgctttaaagatccggatgcgtctcagccggaaatcatgctgtacgtggcgggtaaaaccttccaggtgggcgcgctgatcttctctactatcaccgtactggcttccggtatggcggcgcatgcaggcgtagcgcgcctgatgtacgtaatggggcgcgacggcgtattcccgaaaagcttcttcggttacgttcatccgaaatggcgtacgccagcgatgaacatcatcctggtcggggcgatcgcgctgctggcgattaattttgacctggtgatggcgacggcgctgattaactttggcgcgctggtcgcgtttaccttcgttaacctgtcggtgatttcgcagttctggatccgtgagaagcgtaataagacgttgaaggatcacttccagtatctgttcctgcccatgtgcggcgcgctcacggttggcgcgttgtgggttaacctggaagaaagctcaatggtactgggcctgatctgggcgggtatcgggctgatttatctggcgtgcgtaactaaaagcttccgcaacccggttccacagtacgaagacgtcgcgtaatcgcgcgtattatcggcaatagtaaaaccggaggcagtgcctccggttttttgtctgccatccagcacgtttaccggatggcggcgtcactatttatccgctctggattaacaatgcccgtcaggcattggtcaattacacaatctcagttgcgtactgccacagtgatttcagcagccccagcttcgttttatcttccgcatactgctgagaaagcatctgcaattcattggcatactgttgtaaaaactctggcgtcagtacctgacggcgatgctccagccagcgctgctgctctgcgtcatccagcgtaccgggaaaattgcgtgcgcggtaattaaacagcagcttctcaatgcgcttatcgacaaaggtaatgtccagcgcgggcaggttacgcggctcggtttcgagtacgattttcatggctgcgcgatcggcatcgctgaaaaaaccatcatagagctgggcatcaacgttatccgaggtggcaaaaggttcggcttcggcgaaaatcgccaccactttgtcgcggacctgcgggttttcacgcagcactttcaggttatccaggcaatgctggcggttaattcccagccggtcggcatcctccgggcgcaaggtattcgcctgcgccagtaccggacatttattgatatgcaccagctttaccggcactgcggcgtgatcgccaagatcggctttggccgtataaagccgctcgcgaagggtgtcgctgtccagctcaagaagaggagaaatatcgcctgctaaatcgaccatgatcaccgcgttacggttttcaggatgccacgccagcggcgcgacccagcttgtattaccgcgccacgcgccaaacatgccggagacatgcaccagcggcttcatttgcggaacgtcaatcagcgccgccagtttatgtttactgcggtggctataaagataatcaaacagtcgcggctggcgtgttttcaccagttgcgccatcgcaatagtggcgtagacatccgccatcgcatcatgcgcgttgctgtgttcgatcccgttcgcctgggttaaatgttccagacgaaagctgggcaggccgtcgtcgttttccggccagttaattccctccgggcgcagcgcataacaggcgcgcatgacatccaatagatcccaacgtgaattatcatgctgccagctccaggcgtagggatcgtaaaagttgcgataaaaaatattgcgcgtgacttcatcatcaaaacgtacattgttgtagcccacaacgcaggttttaggaacggtaaacagcgcatgaatgcgtctggcgaaagcggcttcgttttctcctttctcacgcgcttcctgcggcgtgatgccggtaatcagcactgcgccgggctgcggtagataatcatcggcgggtttgcaataaaacacctccggctcgccaataacgttgaagtcgttatccgtacggagcgcggcgaattgcgcaggtctgtcgagggccggatgcgtaccgaaggtttcgtaatcgtggaagaggaatgtgctctgtatgctgtcgtttttaactgtcacttgatgtacacgcctgatgttatctgtatatgaaatattttattcttttattttgtcgttgattgattgtatttgtacaccaattgatattgttgctaatgttcgtacatgcgatggtgagtacataaacattaaaatcattgagtacaaaatactaaaatgaccatcagcgacactaagctacgctccctctatggtaaaccatattccggcccatctgaaattactgattttgatttagtactgtatggaatttaggccagggtcaatctggccgggatctcaaaaaatgcatggactaaaacgggtctatgtacagagggacacaacgctgtgtcccttaatttcatgcgggttgaggctggactaggcccaggccagtggcaggatggatgacagaacactcgggaaatattttctggcatgacgttgcatactatccaccacaacgctggtacaggtaaaggcgccatggaggccgtgaaaacggtcggaccagtcggtaaactgttcgctggacgggaagatcgccggagacagctcccagtctttctgcatcagcgcctccgcatagcctctcagggccggcggagagtcatgctcagtgccgaaaatggcgctggaggaatagcgtgcgaatgcggtactaagacagaacagggtttccgcctgcttctgtggggtggcgtccgtcaggtgataagcactgaggatgtgctggtagtgtgccgggctgagtttgccttcaggaagcagggggtcaaaaatggtgttcagacgcgacactgaggcatcatcaatcaacttcacggtggaatgtttctgggtcgtggcggcaataaactgctggttcagctccccgtgctcttcagcgctgaggatgatatcaatcagttccccaaagcgtcgctgcacggcctgctgattaaatgcggcgagaaacaccggaaagtcatgacggaataactctaccggagagatttgcgcggtggaaacgttctctccggctcgcagcaggtaaaagttgtcccatgcagtgtcaggagtagggtttagcattgttaacagcgtgtcagtggagagcatcatcgccgtgtctgaatcctgggaggaaagcagcaggaaattatctgcagcgcgggttgtccagtccgggctgccgtcataattgccgaagagcccattatggatgtggggagacaccgttgggtgagcaagatatcgttcataaagcgctgcagctttctggcgggtgccatcagtgcagcccacgcctgtcatacagtgtaaaatcacctgattaaagagtccgttgtgagtggtcatggcggcgttgttcctgtcaaacgaatccagcaacacaggccgtatgcgctgctgataatatgtgtcaggagccggcaggggaacgtcattataggtctggcactggtgggcaaaaaaacgttcctgaacaggcccgagccactcgctgataagcgtactttgcgtatagggggggccagtacgctcaccagcgaactttcaactggccggatacatgcctctgttaagcggccactccgcaatgacttaaccaggtcttccattgcccggactttttcctgactgtatttatcgggcaggctgtcaatggttatcagaatacttttaccattattgtgctcatgatttaaaaatccatccacagcgttctcagtccaaaggagtggcatttgcggccagatatcacctggacgaataaaattttcgccccctgatactgacggaggtgatgaattatccggttcatttaaaataacgccagagaggttggctttgtgacgtataagcgtattttttaatgttgtatcaataaaagagggctgttgttgtgtagtaattgaatactgtaaaacacttcattcatgtctgaattactaaattttgtattactgcagactacatcactcagtgtcaaataagtgaatcggcattcgtcaaaatgtaaatgagatatatcagaataagtaaattttgaatttgaaaagttgaacctcttaataatatcgccgtctcgctccatgaagctgaggggcaatattttgctgaatgtaatattacggaaatctgcgtttgaaaaatcgcgatctgcgggcgtaagagtttctccggctttctgccgtaaaactgcatccgtaagtttcttagcccagtcggcaggtgatgacggggaagacgtagcctgaagtgagagggagggtgatactggtggtgttctaccttcagaaaccgttggcctgttattggctgatacagagacttcaccggggagcggggctgcacctgtcactctgtaattataatcacatgattgatttgcaatatgcttacgcatgagtgctgcagtcatttttgagacatcttcttctgaaatatttttcttatatgtattatttgtatctttaatatttttaacagtaagcaatgtattgtttaaggtattttttctttcggctgaaagaattcttttattttttgtggtagcgatatctcaatcggtgagtcctttcatgttttaaatttttcatttaaagatgcatgcgtatttttaacactggttatttttgaggcgagcccgtttttcgtatgttcacggatggtgttaattaattttttaacctggttaggaatagtagaaaaattaattgcgcctgatgatatcttcattagaattccttatcaacatcattatggaaaaacggtctggatttttaacgccttaaaagtaagctccatatgtcggtatggcgttggagatcacaattcaccatgctatctggcatgtttctttcagaaagtgtccatcctgtcatcatgtcaccgtattgtgggacgctggcgtatctgcggaaaaatccaggcataagagagcgggtcgggtaacggagcccgtatgcacgcaaaaataaacccgcttcgacgctcaaccagcgtttttcgccggcattcgggatatcgtcggcggacgttccggcgagtatgaaaaagaactgcgtaaagcgcgtgaaatcgcttttcaggaaataatcgttttcttttaaatattattacgtgttattggaattgtatcatttttataattaacagtgggttgtttggtaattctgctgattattcgatgacagtccatgtgcgtgttcaggaaatgtaaaatatttataaaataaaaggttttatcatgttggcatgctcatattaacaactatttcaaattgtgattgaagccgacatttcataatacaaattaaatataatcttcagctatatctaataacaggaggttatatgagcattagtcgtcgttcttttttgcagggggtaggcataggctgctctgcctgcgcgctgggcgcttttccgcccggggcgctggcgcgcaacccgattgccggcattaacggtaaaaccacgctaacgccaagtttgtgcgaaatgtgttcctttcgttgccctattcaggcgcaggtagtcaataacaagaccgtttttatccagggcaatccttctgcgccgcagcaggggacgcgcatatgcgccaggggcgggagcggcgtcagcctggtcaatgacccgcaacggattgtaaaacctatgaaacgcaccgggccacgcggtgacggtgaatggcaggtgattagctggcaacaggcttaccaggaaatcgcggcgaaaatgaatgccatcaaagcgcagcatggccccgagagcgtggctttctcttccaaatcgggctcgctctccagccatcttttccatctggctacggcctttggttcgcctaatacctttactcacgcctcaacatgccctgccgggaaagccattgcggcaaaagtgatgatgggcggcgatctggcgatggatatcgctaacacgcgctatctggtttcgtttggccacaatttgtatgaagggattgaagttgccgatacccatgagttaatgaccgcgcaggagaagggggccaaaatggtgagcttcgatccgcgtttgtcgatattttccagcaaggcggatgagtggcacgctattcgtcccggaggggatttagcggttctgctggcgatgtgccacgtcatgattgatgaacaactctacgatgcgtcttttgttgagcgttataccagcggatttgaacagttagcacaggcggtaaaagagacgacgtcggaatgggccgccgcgcaggccgatgtcccagccgacgtcattgtccgggtgacacgcgaactggccgcctgtgcgcctcacgctattgtcagtcctggtcatcgcgcgacgttctcgcaggaagagatcgatatgcggcgtatgatttttacgcttaatgtgctgctcggtaatattgagcgcgaaggcgggctatatcagaaaaaaaacgcgtcggtttacaacaaactggccggagaaaaggtcgcgccaacgctggcgaaactcaacattaaaaatatgccgaaaccgacggcgcaacgaatcgatctggtcgcacctcagtttaaatatatcgccgctggcggcggcgtggtgcaaagcattattgacgcggcgttaacccagaagccttacccgataaaggcgtggattatgtcgcggcataatcctttccagaccgtcacctgtcgttcggacctggtaaaaaccgttgagcaactggatctggtggtcagctgcgatgtctatttgagcgagagcgcggcatatgccgactatctgctgccggaatgcacctatctcgaacgggacgaagaggtatccgatatgtcgggtctgcacccggcttacgctctgcgccaacaggtcgtagagccgattggcgaggcgcgtccgagttggcaaatctggaaagaacttggcgagcagttgggattagggcagtactatccgtggcaggatatgcagacgcgccaactctatcagttgaacggcgaccatgccttagcgaaggaactgcgacagaaagggtatctcgaatggggcgttccgctgctattacgcgaaccagaatccgttcgtcagtttacggcgcgttaccccggcgctatcgcgacggacagtgacaacacctatggcgaacagcttcgcttcaaatcgccctccggcaaaatcgaactttattccgcaaccctggaggaattgctccctggctacggcgttccgcgcgttcgtgactttgcgctgaaaaaagagaatgagctttacttcattcaaggcaaggtggccgtgcataccaatggcgcgacgcagtacgtacctttactcagcgagctaatgtgggataacgcggtctgggtccatccgcaaacagcgcaagaaaaaggcattaagaccggcgatgagatctggctggaaaatgccacgggtaaagagaaaggtaaggcgctggtgacgcccggtattcgcccggatacgctttttgtctatatgggatttggcgctaaagctggggctaaaacggcggcgacgacacacggtatccactctggcaatttactgccgcacgtgacgagtccggtatccggtacggtagtgcataccgcaggcgtgacgctgagccgggcatgagggaggagggaaccatgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatctgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaagtccatcaggagggtaaagcatgaatactatctggggagcggaactacattatgcgccagattattggccgctgtggttaatttacgcaggcgtcgtggtgctgctcatgcttgttgggctggttatccatgcgttattgcgccggatgctggcgccaaaaacggcgggcggcgaagagcatcgtgactatctctactcgctggcgattcgccgttggcattggggaaatgcattactgtttgttttattactgttaagcggtttatttggtcatttttctctcggccctgtagcgctaatggtacaagtgcatacctggtgtggttttgccttactggctttctgggtcgggtttgtgctgatcaacctcaccacaggtaacgggcgtcactatcgggtaaatttttccggactagtgacgcgctgcatacgccagacccgtttttacctttttggcatcatgaaaggggaagcgcatccgttcgcggcaacagagcagaataagttcaatccactgcagcaactggcatatctggcgattatgtacgcgctggtaccgctgttaatcatcaccggtttgctgtgtctctatccgcaggttgcgggtctgggccctgtgatgctggtgctgcatatggcgcttgctatcatcggcttactgtttatttgcgcgcatctctatctgtgtactcttggcgacacgccgggacaaattttccgtagcatggttgacggctatcatcgtcatcgtaccgcgccgcgcggggataagtccgccgtctgagcgtatccataaaataaagtcagcaagaaaatgtgccttgtgtcacattttcttgcaatttatccatgtttgtttaactgaacttccgtaaaaagaacggcaaattgagaccatcctgaagacatgctgttgaaacgccgtttgtttattgccgcttctttattcgcgatgcacctttctcctgcgcttgcggccgatgccgtaagttttgctccccaaccgccagccattgatgcaggcgcctgggtgttgatggattacactacgggacaggttcttaccgccggtaatgaacaccagcaacgtaatcccgccagccttaccaagctaatgacgggctacgtcgtcgatcgcgccatcgatagtcatcgtatcagccctgacgatatcgtcaccgttgggcgcgacgcctgggcgaaggataatccggtgtttgtcggctcctcgttgatgtttttaaaagaaggggatcgcgtgtcggtacgcgatttaagccgtggcttaattgtggattccggtaacgatgcctgtgtggcgctggcggattatatcgcgggcgggcagccgcagtttgtggcgatgatgaacagctatgtgaaaaaactcaatttgcaggatacccattttgaaaccgtccacggtctggatgcgccgggacaacatagctccgcgtatgatctggccgtactctcccgggcgattattcacggcgaacctgaattttatcacatgtacagcgagaaaagcctgacctggaacggcatcacacagcagaaccgcaacggcttgttatgggataagaccatgcatatcgatgggcttaaaaccggacacacatcgggggcgggatttaatcttatcgcatcggcggtggacgggcagcgtcgacttatcgccgtcgtgatgggagcgaaaagttcgaaaggacgcgaggaacaggcgcgaaaactgttgcagtggggccagcaaaactttgcgacggtgcagattttgcacagcggcaaaaaagtgggcagcgagcggatctggtacggagacaaagaaaagattgcgctgggtacggaacaggatttctgaatggcgctgcccaaagcggaaattccgcatatcaaagcaaaatatgtgctggatagaaaagagctggaggcgccaatcgccgcccatcaacgggtaggtgaaatagagctctacgatcgggataaactgatcgctcagtggccgctggtcactctggaatcggtgggtaaaggcggtatgttctctcgtctgagcgactattttcagcataaagcgtaagccgttgtcacacaccgttcaccgtcatctgaggtgtcaaaagggcgggattgcgaggttgctcacaaaatgatcacgctgtccttgtgaccgtaaaaggctgtaattatactgtacattaatacagtatagtaaagtgacggaggcagcatggattacgaaatcaggcaggaacaaaaacgcaagatagccggtttccacatggtcggtccatgggaacacaccgtgaagcagggttttgaacaactgatgacgtgggtggatcgacagcggatcgtgccagttgaatggattgccgtctattacgacaatccagatgtcgtacctgcagaaaaactccgctgcgataccgtggtgtccgtggcagagaatttcatcctgccggacaatagcgaaggcgtaatcgtgaccgccattgaaggcggcgaatatgccactgctgtcgcgcgagtggaagaccgtgactttgcgaagccgtgggaacggttttttgatgtcctcgagcaggatagcgcttatcagatagcctctgcgccctgttttgaaacctatctgaataacggcatggaagatggatactgggatattgaaatgtatattccggtacagcggaagtgatcgactggtttcctggctgaaaagagcggacggataatgtgttccgtccgccagtgcgctatttttgctataaagcaggtacaatgcattttttgccattcccgtaaggagcgcaagcgtgcgtgccgataagtcattaagcccttttgaaatacggttgtaccgtcattatcgcatcgtgcatggcatacgtatcgccctggcgttcattcttacctttctgctggttcgtctgttttctattcccgagggcacatggccgctaatcacgttagtggtgattatggggcccatctcattctggggaaatgtagtgcctcgtgcttttgagcgcataggcggtacgattctgggcgcggcgttagggctggtggcgctacgcctggagctcttttccttaccgctgatgctggtgtggtgtgcgatagcgatgtttttgtgcggctggctggccttagggaaaaaaccgtatcaggcgctactgataggcataacgctcgccgttgttgtcggcgctcccgctggtgatatgaatacggcattatggcgtggcggggatgtgattttgggggcgctactggcaatgttgtttaccggcatctggccccagcgcgcctttttgcactggcgcatccaactggcgcattgcgtcacggcgtataatcgggtgtatcaggcagcgctgtcgccgaatttgctggagcgcccccggttggataaatatttgcaacggttgctgaacgatgtcgtcaaaatgcgcgggctgataacgccagccagtaaagaaacccggatacaaaaatctattttcgaggccattcagaccatcaaccgcaatctggtttgtatgcttgaattacaaatcaatgcccactgggcgacgcgcgccagccattttgtgatgcttaacacgcacacattgcgtgaaacccagcagatgacgcagcaaaccttgctaacgatcgcccacgcgttgtttgaaggcaacccgcagccggtactagcaaataccggtaaactgaatgatattgctgccgagttgcgacagctaatgaacgagcagcagggcgacgcggtggctgaaacccccatccacggctatgtttggctaagtatggaaacggcccgacagttggaactgctttcacacttgatctgccgggctttgcgcaaataaaaagcagatggggtgaatgaatttgttgctgcttcgattcagcaaagattaagagtatgatactaatataaggataaaatgagtgctactggcaacgattttatccccgaaccttcaggtttccccagacggcgacgtaacggtgtttcttctggcggcttgaagtatgacggggataaacgtaatgtttatccactagcagttgcttaacgaatccgaatctcacattatcaggggtgtaaaaatggaaacaaccaagccttctttccaggacgtgctggagtttgttcgtctgttccgtcgcaaaaataaactgcagcgtgaaattcaggacattgagaagaagatccgtgacaaccagaagcgtgtgctgctgctggacaacctgagcgactacatcaagccaggtatgagcgttgaggcgattcagggtatcatcgccagtatgaaaagcgactatgaagatcgcgttgatgactacatcattaaaaatgccgaaatctccaaagagcgtcgcgacatttccaaaaagctgaaagcgatgggcgaaatgaaacacgccgatgtaaaagccgaataatgcgctacggcagtgggagcgtatatcaggctctcactgcagtttgaccccgcctgtgaccatcttgagtaaatgttgttttggccagtgtcgggtaagttttttctctgccagcttacctttcagacgcgcaatatcatgacgtttccggtccagcatcagacccaccacgctaccgctatgcgccacgttcaatccgtataaatcacactcttcgaccagcgacagcagggcggtaaagcccgacttaggtaacagcgtctggctggcgatagcgctaagcgtagccgcctcacccagtcggagcggattttgcgttatacaggcttcctgcaccagattccaggcctgctgcaaggttggtgaacttgctattaatttctgctggcgagggagacggtggtaatcttgcgtgcgcagtgtgaccgggctttccagtaccagcaaatcgattggcggcggtggctcgcaggcgatttgcgtggccgcattattatgatcaaacagcgttaactgatgaaaaacggtgctatcagtgggttcgattgagacgcaaagctgtgcaagggtggtttcatccagcgaatggccaagatgatgcgccgttgccaccgccgtagcggcaatatctgcggtgctgctggccatgcctttggcaacgggaattgacgaacgcacatcgacgcgaatctcgttactccagtgcgcaggatactgccagtgcgccagaacgcgctccaccatcgcccgcgacaatggacgctcgtttaccaacggcggcgcagccgtgactgctacggtgctgtaccagtcaacggggcaggagaccagtttctcactgcccagaatccatccctggataagttccccgcatgaggcggggcattgcgcaacagccacgttatcacctttcaggtacgaatagtgtgcgcgcatagtgtcatggtaaaagcgttattaccatgacttgccgcaatgcgtcgtatacccctctcaggctggtacacaaagcccttccgtggccggtagcgcaatgcgcataacgtcttgtgcgatcattaactcttcgttggtgttgatgacggcgactttcaccagggcgttctccgtctggataaatgttgcattacgttgatttttctcttcatcaacggctaagcctaaaaattgcaaattatggcaaaccgccgatctggcgcgcgctgagttctcgccaattcccccagtgaataccagagcatccagtcctcccatttgcataatatagccaccaatggtggcgcgaatgcgttcggcaaacagcgtgagagcgagtttagcctgccggttaccggtattggctgcctgttcgacatcgcggtaatcagacgacacgccagaaacgcccagcaagcctgactcattatttaataactgattcaactgttgcggcgttttgcattcgcgctgggctatccacggcagaatagagggatcaatatctccgctacgggtgcccatcatcacgcctgactgcggcgtaaagcccatcgacgtattgaccgaacgtccgttcttgatggcgcagacgctgctaccgtttccaagatgacaacaaatcacccgtaatgcgctgagtggtacgcccagcttttcagccagaacgccgctgacatacttatggctggtgccatgaaagccataacggcgaatccccagttcagcgtaataatgccagggaagcgggtaaatataggcgggttcatccagcgtctggtgaaatgccgtatcaaacacggctacagaaggggcatcaggcaacagttgacgaaaaacgtgaatacccaacgcgtttaccgggttgtgaagcggggccagttcagcaagacgttcgatttgcgctaacgtttcatccgtgaccagcgtcgagtctttaaaaaactcaccgccgtgcgccacacgatggcccaccccgtcaatgtcccgcagactgttaatgatttgataacccagcagcttttccagaagcagcgttaccgcatcgcgatgatcggcaacggggacggtttcctgccatttttggctgtgcgtcttaattgtcacctgcgcatccgccataccgatacgctcaatcagcccctggcagagcatgtcgccctgcggcatctccagcagctggaactttaacgatgagctgccggcgttaatggccattattttgtaagacataaaggttccttcgaattcagaaaatccagcacggcgtcgagacccgaattattcaacgcgctggtaataaaaatctgccgggcgccagcctgcgtaagccattgtgcgaccagcgaaatacgctgcgggtcggcgagatcggctttggtgacaaggccaatcgtcgggcggttcatcgggacggtaaaacccggagaaaacggcgaccactgagcgtcggcatttaacaccagggcgataacgtcggcctcgcaggcgctggtcagcagggcgctgtacaggcagcggttctccaggtattcgcccggcgtgtcgatagccatcggcgaccattcaatggcctgggttttcttgtaatggagcgcttcgccacgcaggctttgggtcagcgaagttttcccgcactggctggggccgataaacatcagacgcttcattggattacgtccgggtgatcgagcaggtagtgaactgcatcatctcgcccagggtgcgcgttacctgcttgagggcatattccacggcggaaacatcgccggtcagcaccacagcaccggtaaagcggtcaagaaaaccaatctccaccgcgccggattttgtagcaatatcgcaggcgataatcgacgcttcgctgggcgtgatggtgaggatgccaatggcggaaaccgcatcctgcaggcccagcttcttaaataaatctttccccggattagcaatcaggtgcgcgagggtcacctgtttccccggcacgtattcctgaatcatgcgatccgttgtcggttgtctttccattatccctccaccatctgtcgccacatggcttcatgcgagcgtgggatcaccgaacggtaaaccagcagccctttttcgcccgcgctttcgctggcgaccgtcacggcgttattgacgtcagaaacgtcgcccgccaccaccatgtagcatttaccgccgatgccgaaggccatatgcacccgcaccagggtgacgtttgagcctttcaccgcccggtctgcggcgctaatgcaggccgccacgctccaggtttcgacgatgccgaccgcctgacgcttatcgacgctgttcaggccgctgatggccggaagtacgctgggatgaatatttgccagcaccaggctgtcgacgagcatctcgccggcctgcgacgtaccggtttcaatggcctgctggatagcgccgatatcgccgcccagcatcagtaaaaacttacttgggcagatggtcttgctgaccagtagatcgacgttggcgcttttcagcatggcatcaccaagctccatgcctttggcgatgctggtgagttctaaaattcctatagcctgagacatggttaacctcttacaacagtgatggcctgttcgctgatggccgaaacaatgccgtcgatgctggcgtgaatggatgcgccgagcgcgccaggcgggacatcggcaacgcattgcccgcgagtcacgcgctcgccgacggcaacagtcggtactgcgctggcaccaatatgctggcgcagctgcaaagtgactttttctactgacggctcttcttcaaccagcggcgcttcctggtaccaggggcttagtcccagtttggcgatcagccgcttcaccggcaccaggcgatatttcgccatttcgtcggccggattcagcggcccttcgtagcgctggttttgcgcccgcagctcgcgttttaacatgcggttgatgcgcatcggcgagatcccgaccgggcaggccacgctttcgcaaacgttgcattccgagcaggtaagggcgctcagcagcagttgcggcgtggcagcctgatgaaagttcaccgcccgcaccagcaggtgcggagagagttcgtggccgatcagatgtcgtgggcagagatcggtacagagtcggcactgttcgcagacggtgcgcgcgacggaaagcactgtgcgctcgtcctgcatcctgcgctggataagcggatggctttttgggagcaccagcaggccgccggtagttttcgtcaccgggttatcaagagaggtaatcaggccacccatcatcgggccgccgttaataaaaccggggttgtcgaccgtcgcgccgccagccagcgccagcacttcatgcagtgacatgccgacaggaacggtaacggtcaacggtctggcgaccgcgccgttcacggtcaacgtgcgacgagtgaccggaaactgctgctcgaccgcccgggcaatattcagcaccgtttgcacgttattgacgactacgccgacgctggcaggcagcgcggcaggggcgacccgacgaccggttgccatccagatagtcagcacctcatcgcccgcgggatatacatccggcaggatatgcaggcggataccggctggcagtagtggggagagggcgtcgatggcccggcggtatttttctttcagggcaatcaccccttcgcgcgcgccggttgccgtcatggcgtactgcacgccgcggacaagacgcgcggcctgctgccacatcagttgctggtcaactttgagcatcggttcacactcggcggcgttcaccagaaaaatctctacctgcgcctgtagcttaacgtgggcgggaaaacctgcgccgcccgcaccgacaacgcccgctgcgcgaacgcgctcacgaatttcatcggcgctaagggacatttaaacgctgttgatggcggcgctcatagcagttcctccagcagttcacgaatttcctcggcgctggccgggcgcgggttggtgcgcaacgtgacatccgccagcgcggcctgcaccatcgctggaatacgtgcggaaaagtcggatcttccttcttttagcgcaacggccagtgagggaagggcacagcgttgcttaagcagttcgatttgctgaatcagcgcattgatcgccgtgacatcgttggcttctgccgggcaaaaaccgcaggctttggccagccgcgcgtagcgtttggctgcgcgcggaactccggcgttaaaacggatcaccgtcgtgagcagcagcgcattggccaggccatgcggaagatgaaactgtccgccaagctggtgggctatcgcgtggttaagccccagccccgcctggctgaaggccatcccggcgagcgttgaggcgttatgcatttttcctcgcgtcgccacgcagtcgcctttttccaccgccgtcggcagatactggaacaccagtttggcggctttttccgccagcgcgtcggtaaagtcgctggcgtgcggtgacacccaggcctccagggcgtgggtcagcacgtccatgccggtgttggcggtaatctgcggcggtacgctgaccaccagctccgggtcgaggatcgccatatccggatacagcgcattgttgaacagcggatacttgatgcctttatccggatcgctaattacgcaggcgctggtgacttccgaaccagtgccgctggtggtcgggatcgccacgcaggtttcgatattgatgccgctttgttggctaaaccagacaatcgctttcgccgcgtccattgccgagccgccgccaaaaccaatcaccacctgcggctgcagggcctgcatttgcgcaatgccctgcaccacggtatggatggtggggtccggcgttatctcgctaaagacgctgatgcggttatctgcgggcagcgcgttacacagggtatccagcagcggcgagcgtgccagaaagccatcgcagattatccagatgtgcttattggtaaagcgcttgagcaccgccaggctgccctgaccgctgtacaaccgcgtttgtagtgagaaggtgttcatcgcgacctcggttagcgaatagaaaagccgttggtcagcacgcagcgccgggagcgggcaaaagtacgcgctgacgttgttccttcaccggttggcgtggcaatggtaaaggtggtaaagccttcgccgccgacgccgatcccggcataagaagggccgtttttgacgaatatcgaggtttgcagggtgcgggccgcgaggttcaggcgcgacacgttctgcgagtgcatgatcgcggtgtgatgcaacccctcttcaaccttcagggccagtgccagcgcgctatcgaaatcgttaacttttaccaccggcagcatcggcatcagctgttctctggtgacccacggatcgtcagcgttaaccagcgcaatcagcagacgcggcgcttttgcagggacagcgatcccggcggcttccagcatggccgatgggctcttgccgaccagttttttattcgcctggccttcaggcaggcagacggcgcggagtttgtcggtatcggcagggcttagcagcagcgcgccgaaggtttgcatttgctgcaccagacgttcggcgacgctctccaccacgatcaggctcttctcggcaatgcagggcaggttgtaatcgaatgacgcgccgttgatgatatcttccgccgctttcaccaggtccgctgtttcatcaacgatgcagggcggattgccagcgccagcgccaatcaccttcttaccgctcttcatgcccatggccacaatgccggggccgccggtaatagccagtaccgcgattcgcgggtgggccatcatctgctgggtcgcttcgaaagtcggttccgccacggtcaccaccagattgcggatgccgcagcagcggaaggcaatctcttcaatcagactaatcagcttcagagagacctttttcgctcccggatgcgggctaaagtagatactattgcccgccgccaacatgctgatgctgttattaatgatggtttccgtcgggttggtgcttggggcgactgaaccgatgacgccaaacggcgagtattcaaagagtaccatgccgccgtcaccggtcagcgcggtggtggtgagatcttctacgcccggcgtgttgtccagagcagccttgtttttgaggaatttatcttctttgttgcccattcccgtttcattggcgctctcctctgccagagcagccagcagcggcgtcagctcctgacgcatcgcgctgataatggcgctgcgggtttttagcgggcactgctgataacgtaagaacgcctgatgcgcggcgtcgatggcctcgctcacggactggaaaatccctttgccctgaggctgggccggtgtttgcgctggcgtggttaattgctcgctaagaatggtgcgaatcagggtttcgagttcagaagtattcattgatgtgttcccacgttaatagccgcgatggcggtctgtgctatgtccatgtcctgctcaacgctgccgccactgatgccaagacccccaattaatatgccgtcgcgccatagggcgtaaccgccgccaaaggtgaccacttttccctgtaaatgactttccagaccgtaaagcgccgcgcctggctgaacgacatcgctcagctcatgggtcgccgttttcatcgccactgcggtccatgcctttttcggtgccagttcgctgctgaccagcagggcgtccggcatccgccaggtcacagtttccgtgccgtgcgcgtcaacgatgctgacgactaccggaacctgcagttgctgcgcgcgttcaacggcggcgcgggtgagctggtgcagatcgtggaatgagagggccacgggcgttgtctccttgctgcgggtcggctggctggcagccagatagcgcttgctaacttcacggatgatgttggcctggtgcgcatcgctatcttccgcgcgggccagggcgtacaggcagtccgataagcggttgatgtagcgcatcagcacttggcgtacgttgacttcagttgccagttcaaccagacggcgttcggcgcggcgcgccagcgtgcgggcaaaatgtaatcggctcgcggcttcgcagcgtccgggtaaaataaagctgtgcagcggttcgacgcgggccattgcccgatcgatagcggcttccagggccgaaatctcttcgctgctgatgtagcgctgtttgggcgatggctgctcgctgtcgctggccagctctgcgctaaaccaaaaaagttgctgctggatggcctcgagtaaggtgcggtgattttcatccgcagcggcgcaggcgcacaggctcagcgcggcgttcagttcatccagcgtgccgtaggcttcaacccgcgggtgggttttgctcacccgctggccggtaaacagtgatgtggtgccagcgtcacctgttcgggtataaatcgccataaccgccccttaacgcgaaagcgtatctacaatgccgacaacggcgaggtcgatggcctcatttggcccggaaaaaacgtgcctggcgctggagccgccgctgagcaaaaccagttcgccgacgcccgcgccgacggagtccacggccacttcatcgccggaggtgggcgaggcggggagttcgccatcggcgctgacccgacgcaccagcagcagcttttcccaatcaaagaaggtgatttttgcgtggagacaaccgcgcccgtgactcgtgccagatgcatgatttactcctgcttaattaattgaatattccgcgcattggccgcgtcacgcgccatggcggtcacgatgcatttgcggtggacaaccacacgcccccggcttagcagcgcgacatcgcgatagcccagcaccgaacccgcatgcagaaccagcggcagtccgtgctcgtcggtgaataccagcggcagacgagccagtttttttaccgggataaccggcagcagctggctgtgcaggctgagctgtacgcggatgccaaacgccagcgcgtcgtgaattttccgggctgcggcatcgtcggtttctgcatccgcaagctgacccagcagcggcaggtcgacgagcaggatgcgcagcgacgcgtgctgacagaacagcgctggacagtcggcatcgcgaagctgcgcaacgctcagcgttgccgtgctcagggcacgacgctgcagtcgggagacaatctcctcgacaatgcgctgcagagtttcgccgttcatcgcgggcctaccagccgggcaaaggcctgcgggttatcggcaccagcggcgttggcttcatcggtatcaatgtgcatttcgaggcgcatgtccggtgaaacgcgaatcgccacattgttgaaaatcagcccgcgctcgtcgccttcaatcgctaccgaaaccctatcgccgtgggagaccttcaggatcagcgcatcaagcggcgacatatgaatatgccgctgcgcgacgataaccccggaaggtagctccagttcgccaaaggggctgaccaggcggatgccaggtgtgcccttcaggttgccggacattctcagcggcgcggcaatccccagtgttctggcatcggtacgcgatatttctacctggcttaccgagcgcagcgggccgagcaggcgcacatttttgagctgtcctttcggccctaccagggtgacggtttgctccgtagcatattgtcccggctgcagtagcgcttttttttcgctgatgggatggccgggaaacagccgctcataatcctgcgcggacaggtggatatgacggtttgagacgcccagcggaataggccgctggcgcatctcgtcgagaactttacggaccgttgattgcagaagctctttatccattacgcttcacctcgcttgccggaatgaatgcaaagcgtacgaggttcgcccttctggcgcggacattttggatccagacacagattgcagctgaccagttctgattcctgcggggcctcttcggctggcgcttcagaaacgacatcagctatctctgacgcttcaggctcaggttcaatgacggagggggagggtgtctctgcgagcaggatcccttctccgggcctggcgataaccttgtgggccaccagaccattccgctgttcggcaaattgcgcaccggtggtgatggccgcctgcacggaggccacatcaccggcaattttaatcaccatccagcctgaaccattggtcttttcgagggcgagcagcgtgatagaagcggatttcgccatgatatcggcgcagctgatagccagtgccagaccacaaacttcaagtaatcccagtgattgcttcacgcggtgctccttattcgccatcgattaggctgatttcggtaaaatggcctcaacatcgctgtgcggacgcgggataacgtggcaggatttcacttcacccacgacgcttgccgccgcgctgccggcatctacggctgctttaaccgcgccgacgtcgccgcgaaccatgactgtaaccaggccagaaccaattttttcgtagcccaccagctgtacgttggcggatttaaccatggcgtcggcagcttcaatggcgcctactaacccttttgtttcaaccagtcccagtgcgttattcatactgcagttctcctgttgcttagctattcagatcccggaaagggatccctttgaccagccgtgccgcgttattaccggtgttgcgttgggcctgactgtcctgatgatgcatcagcgtaaaaagcggcgccgatgcgggtaaattcttgtaatgtacgaccagcgagtgtcgatcgcaggcaatgccgaccagcagcggcgagctgcgcgccgcctgccaggcgctgtcaacgacatctccagctgggtgatgctgaagcaggaaagggatgccttcctcttcaatgcccagcagcacttcgtgccagaggctggcgcagtcgttgatgacggtaatgacgatagccggggcgctgtgattactgtccatatgcaaactccttgtgccaggagagaatcagaccggtggccaccgcgtttcttgggccttcgctgccgcgaatatttcctcgcccggcgactaggcggtagtgcgccagcgcatcggtgaccaactgcggaacttcgaaatccagcgacgagccgccgaccagcaccacgaacggaatatcgcgaatgttgccggttggactgacctgacgcagcgcgcgcagggcgttggtgacaaagacgcgttctttagcgctgcggcgaatggcgcgcactttttccagcgctaagtcgccgggaagcggcaccagttcgtccggtttcaccacgcagacgcgggcgaacaccgcaggaggcagcggcgtcgggaagaactggacgctgccgtcctcgtggcgtaagtggaacaggctttcgaccttagccagcgggtattttttgatctcttccgccagatagcggtcttccagccccagttcgcgggcaataatcatcgtgaccatgtcgcctgccccggcgagatgggtggcgatgatttcacctttagggttgatgatggaggcatcggtggagcccgcgccgaggtcgaggatcgccagcggtcgggtggtacccggcgtggtcagcgcgcccagaatggcggcttcagcctcagcgccgccgatctgcacgtcgatattaagcttctgctcaatttcacgggcaatcatcgccatttgcagacggtctgatttcaccatcgaggcgatgccgacggcctgctccagcgagaactccccggccagaccgccggtgacgctcaccggaaccgaggtgtcaacggccagaagatcctgaatgaaaatctcgctgctcggcttattggttagctcggccatggtctggcgcacatgctccagcatgccgccgatattggtcccggcctcgccgttgacgttgtcgagcttgccgtagccgtccaccgctttcatgatagcttcggcaccggcggcaacatccacgcgcacggtacgaccctgagcctgcagctccaggttaccggcgggtattgcgcgcgctttgacgtcgccggatggcgttttaaccaccacggcggaacggttgccaatcagcgcgcgcgccatcgggacgatgtttttcgtctcatcggcgttgaggttgaatacggtggcgatgccgtaagggttagagagggtttcgataacctttcccggcacggcgacttcaatcgccgccagcatccccagcggaatgcagtcgatgtacagaacttcatcgacaatcggtagcgatttttccagccggttgctgaccagtacgccatcgtcgcgctgcaaaatgacgccggtaatctggtatccggcgcgcattgaggcgttgataacattggcgatatcagcaaaatcaaaggctgacgataccaccagaatataggacgagtccgccgggcgggttaacagctcctccggcgtaatcgtgatacccacaccaaggcctgctccgcccggcgtttttgggttatggccgatcattgtcgattcggtgatgatggtttcggtaatggtttccatcgccacatcgccaatcaccggcgtggcttcgttaatgcggatgagcgaaatatcgctgacattgatccccgcgcgctttgcgacgagggcgagcgcttcctgaatgccgaacacgttacgcaacgtgcctttgatcccggtgttttccgccagcgcgctgtgtgtaatcgttagtgcgccagtctcatcttgccgcgccagtgcgacttccgttgatgagttaccgatgtcaatgccagctatatatcgcatcgtatatcctttttctcgtcgtacttcaaactgcctttttgttggctgcgttctttcacccgaatcacttactacagtaagctcatcggggttatgagggacatccctgtccctcactaaagccagcctatggctgttcaaattcgttccagacgaatttgtcactcacttgccgcctcaatgcatctcgaattacttagagaaagctaatcgtcgcctttgagttttttacgctcaacgtacagccctgccgcttcacgaacgaaagctgcgcaaatctttgcctgataacggttttcgagatcgtcggcgatagcgagcagctcttctttcgttgaacgatacggacgaagggcgttgtagatttcaagaatgcgatcgtccggtaccgcggtcagttcggcggcgcgttcgaagttcatcgccagccggtcgcggcccgcatctttggcgatagacgcctgtaagcgcagggttttcggggtaatacgcatatcctgagcggtgactttattgctcagcacgttttccagcgtaaagtcgtccagcgttttattggtggcggttttcacccattccgggtgtttgttcgccagcgggtagtcgctgacctttgcgctgcgggacgtgccgcctgccgcaggagccgctgctggcgcatcgccctgcaggctgttcatgcggctcaatacgtcccggaccatcgattcaattgcgtcggtattcatggagttatcctttatcaaagcgtcacgcgcagttcctgcgggtttttgcccgtcacgacgtacttggtctctttaatgtgcaaaatggccgactttgcctggtacttcgggcgtgccatctggtcatttagcgtagggaccggctgcggtgattcgcgtttcgcatagcgggcggcgtttttaccaatctgacggtaggtttccagcgtcagcagcggcgcctgcgggaacagctccaggttggagagcggcggtagcccctgctggtggataaccgtagtatctttcgactggatgccgatggagatgccggagccgctcaggcggttaccttcaacggcgacgaacgccacgtcggaagatttaaagcagcgaatcacgcgcgccctgataccttcttcttcaataccggcaatgacttcgcgcaggatgctcttatgcggtaagccgacgatattaacagtctgtgccaggccaaatgccgggccgacggcgataatgacttcgtcctgctgagtgccctggcgtgcttcgcccacttcggtcagaaagccgtcgcccgcaggcgcagcggtctgtggtgctgtggatgccgcaggcgtattaaacgagacgggtttatcgctgcccttcatatcgcggagcacgtcttcaattatctggcgcagcaatttttcattaatttccatttctcaccccttaatcaatctcgttgggatcaagagcgccagggatgtttttaatctcttcccagcgttctccctgcaggcgataacctgttgccggaccggcatagtcattgacgtcattaaccgcagagagcacttgtccgtcgccgacgataatggcggaggtgtgcaaatagtcgccggttagcttggctttctggatgttgagcatgtcctgggccacgtcggtaaacccgccctgcgccagcgctttaacgacttccagaccgttgcggtttttattgatgatttcctgggcgaacttgatgtcttcgacgatgttacgctccggcatatctttcgaaccgtgggcataggtcgcggcttcaacttcttcatcggtaatcggcggcagccccattccggcaaacacggcctgcagcgcgcgggcggctttgttacggatggcgataacgtcctcttcacgaaccgggcgcagaccgccgtccactttcaggtcgcgctggataacgttgtagtcgtcaaagtcttccgcatcttcgttggaaccggcgaacatgttgtcgtagttcggcaccgcggaataaccagaggagataaagtcggtacccggcaggaactgcatcagcaggcgcgcggtacgacgcatatcggagtgggtgaaggtctggtcgttactggaggagcattccagatccagcgaagagcagatcaggttttccgccagcacggcacgaatgcctgacggcacggcagacggtacgccgatacagcttacggagccattttgcagaccctgaacgccagccgctttggtgatatagatgcagcgcgcctccagatacagcatggatttgccttcggcgtagcccatctgcacttcggatccggagccggaggtgaagcgcattttcaggccgcgagaggcgtaggaagaggctaagaagcctttcgaccatggcgtatcgtcaccgtcggtgaagaccggctcggtgccgtaaacggaaatggtttcggcgtagcaggtgtggcccagcatgccgagcttcagctcggtggcttcttccagggagcactgagtcagtacgcccggacgaccaacctgagagccgaccaacagcgcgatggcgttgaacggcgcgtagcgtgctaccgcaaccgtggtttcttgttcgtcaaacccgcgccatgcgccttcggcggcatcggcggcaatttgcaccgggttatccttgacgttggtgacgtgcgcctgctgagacggcgtgcggcgtgcgcgcattttctgcatcgccatcatcatctcaaccacgttcatatgcgaaaccacttcaacaattttcgccggggtcatggcggtggtcagcggaacgatttcgctgcgcttgacgttcggatcgcagagcatgttagccagcttgaccgaatccatcgccatcacttcttcggcgcggttcaggttgatgccgtagcgggcgataaagtggtcgatcaggtcgaattcgctaaccggttttccgtccagctcggtcaccgcgccgttaacgattttaatcgacggttttggatcgttcgggctttccatcgcgataaagccttcttcgatccactccttaacgaagccgtcctgattcacagggcgtttcgccagtgcttcaaatcttttcgatctcatgaatcagcctcgtgggtatcagatgtaggacgggcgatcgtttttcggttcagaaccgagggtcgcaaggacggttttgccgatttcgcgggcggaggtcaccgcctgacggaccgcgccggagtcgccggaaatcaccagaatggcttcgttactaaagctggtgccgtgcgccggagagctgtacgccacgacttcaacgttggctgacttcagggcggtatcggccatcagtacgccaacggaagccggagcgccgacgatgacgccgcaggcacggccaatcggcgcgccgaacgttttttccagggcgtagctggcgcgagcggtgtactgcagctcgatatgcccggcttcgttgccgtaaacatcgccgaaggtgcggtccagctctttcagcgcgacttcgataccgcgcttgacgtcggaaacgtcgttaccgcctaaaataatcagcgaaccgtggcccgcgccgcctttggtatcgcgcggcagctcaatgctgaccacttcggtgttggtggctttcaccgcttcgtccgccgccataatgtgcgggcctgcgccggtgcgggcgccgagaatgccgatggaacgatagcgcttctcaagtttcatcgcgtccagcagggcggtatcgacgttggcgataaccaggccaagggtatcgccaatggcggtcccgacaaattccgttaaactgcagcttttttctgccatagccgtctctcgtataggttggggttgaccagggatggcctgttgttccggcgttgccacacgggcaatcacctgcgccatgatctgttccaccagctcattgctgctcattggctaattcccttcggtaagattttttctacatcggtgtgagggcgtgggatgacgtgtacggctttcacttcacccacgttgcgtgcggctgcggcacctgcatcggtggccgctttgaccgcgccaacatcgccgcgcacgatgacggttaccagcccggagccaatcttttcatagcccactaacatcacattggctgacttaaccattgcatcagcggcctctatgactgcggttaagcctttggtttctaccattcctagtgcttcttgttgcataaagacctcgcatggagtgttccgatagttgggactataagaagatgcgaggaaaaagaatggctgacttgctgttgagcatcagaaaataatgggaaagcaatatgactaaattgtcttttgcttttataacttattgataaattacatttaatttattattgtctatatgattattttgtttttattatttcatttttacatttttgttagtgacgagagtatttttatttgatatggcgaaagacgcaaaatgtgatgcttattcgaaattgataagttggcttgtgcaatattttattattttcacaggcgtattttatagctcgaatctcccgtatgataggctgctaaaaatatcggaaaagcaaaattttgctatcgcaacacgatttttccgggagacaggttcgcaggttgccaacaatttacaggcggcactttttatagtgaggttagctgtactctaccgccagccgaaacttgcgctggccaggacacgaactttgctcagaaggtgtcacatgaatgattctctaaaggcgcaatgtggtgcggaatttttaggcaccggactctttttgttttttggtatcggttgtttgagcgcgctcaaagtcgcaggcgccagcctcggattatgggagatttgcattatttgggggcttggaatttcactggccgtttaccttactgccggaatctccggcggacatcttaaccctgcggtgacgattgcgctgtggctgtttgcctgcttccccaaacagaaagtattgccttatattattgcccagtttgccggcgcttttggcggcgatctgctggcgtatgtgctttatagtagcctttttactgaatttgagactgcgcatcatatggtgcgcggtagcgtcgaaagtttgcaattagccagcattttcagtacctatccggccgcagcgctaaatgtatggcaggctgcgttggtggaagtggtcattacgtcgatcctgatgggcatgatcatggcattgacggatgatggcaatggtattcctaaagggccgcttgcgcctttgcttattgggatactggttgccgttatcggcgcgtctactggaccccttaccggttttgcaatgaacccggcgcgtgattttggtcccaaactgttcacatggttagcggggtgggggaacatggcgatgagcggtgggcgagagatcccttattttatcgtgccgattgtcgcgcctgttatcggcgcctgtgctggagcagccatatatcgctattttattggtaagaatttaccttgtaaccgctgtaaactgtaagaaaatgcgaaccagattcacagcaatgatgtatcgtaaaaacaggtgagataatttcgtgatctgctttcacgaactgatcaaaacgtctcccagcaatgggagacttttgatattgtcattgtactttttatcagggccaggataatgctaataaaaagtgaatgtaaataatgtgttttgtttataacaataaattaactgaggggttttatcatgatttctgcgagcgctctgaactcagaactcattaataaaatcgcacaggattttgcacaagccaccaccggtctggcggttgtggttgtcaatattcatggtgatgaaatatctgagctattcaatttcacgccgttttgtcagttgatgcggcagcatccccagcatagtacacgttgtcgtatgagcgatcgctgcgggggactggaggcatcgaagtccgatcaaccctgtatttatcgttgtcatgccggtctaacggatttttctattccgctggtaatcgcagggcatttagttggctttgttttatgcgggcaggttcgtttaagtaatgacgtggagctggtaaacattcttaatgtcgacgatcgctggcaggctgaccctgagctcttgaatgaatttcggaatgtgccagagatggactattcacgcgttatcgcttccgccgatcttcttaaactgatagttgagaattgcctgaaaaaacagctcaatttcgtggttatcaaagacaatccgcagcaatcggaggcaaataaaaccactcgtggccccactccgcatgacagtaaaatgaaaaaagcgcttcgctatattgatgcgcatttgtccgacgatcttcgtcttgaggatgtcgcctcacatgtctatctcagcccctattacttcagtaagctattcaagaaatatcagggaatcggatttaatgcgtgggtgaaccgccagagaatggttagcgccagagaattgctttgccatagtgactggagtattgccagtattgcgcgtaatttaggcttttcgcaaaccagttatttttgcaaagtcttccgccagacctatcaggttacgccgcaggcttatcgtcagcagataaatgagaattctcatcctccatcgatataaatagcaatattttgctattgccgatttttgatagtgttttgtatcttaatcatttcagaaagaaaatttatctggtgtaacaataaattgtcatagcgcaacaaaataataaaatttagggcataaactgcaccagtttttatttttgtgatgaagtacagtgtcaggaaagataagttttattacgctttgtcgatacgttttatcgtcaatataccggtaaggatgagtagattaacgtcagatgagcaaccgctcaggctattgctcacagaaatgtaaaacgtagcacattattaattgccgttatgggtgtgccgtacagccataacgtaaaccaacaggtttgccacatttgtggtagggaagggggtgaaaatcccccgcagcccccgctgctgtgatgctgacgaccccgtaaagaccactgatcgcaagattgggaaggacgggcgaggaggacgctaagccagaagacctgcctgtcggtgataaccaacaacttcggtgggaagtgggttgcgaagacgcgtacagtcgaaagactgaacatgcgcgtacctgtatacccctaccaccctgaacaggatcagggtaatggcggcaaggcatcacgctttattcttgcaggcacaggaagcggttgcggcaaaaccacggtgacgcttggtttgttgaggctgctgcaaaaacgcgcgctgcgcgtacagccgtttaaagttgggccagattaccttgataccggctggcataccgctatctgtggcgtggcgtcccgtaatcttgacagtttcatgcttcctcctcctgttctcaacgccttattttgcgaacaaatgcggcaggcggatatcgctgtcattgaaggcgtcatggggctgtatgacggctatggcgtcgaccccaattactgcagcacagccgcgatggccaaacagcttggttgcccggtcatcctactggtggacggcaaggctgtttcaacgtcgcttgcggctatcgttatgggatttcagcacttcgacccgaccctcaacctcgcgggcgtgattgtgaatcgcgtcactagcgacgcccactatcagctcctcaaaaatgccattgaacattattgctcactgccggtactggggtatgtccctccttgcgacggcgtcgcattacctgaacgccacctggggttgattaccgccagagaatccctcgtcaatcagcaatcatggcatgattttgccgccacgctggaacaaacagtggatgtggatgcgctactctcgctgagcctgttatcagcgcttccggcgggaatgtggcctgaacgccccgataacacagcgggggcagggctgacgcttgctctggcggatgatgaggcctttaacttttattaccccgataacatcgatttgctggagcgtgccggcgttaacattgtgcgttttagcccactgcatgaccgcgcattgcctgattgtcagatgatctggctgggcggtggatatcctgaattatacgccgcggatctggcggcaaatacggcgatgttaaaacatttgcgggcggcgcatcagcgcggcgtggcgatttacgcggagtgtggcggtctgatgtatctggggagcactctggaggatagcggcggggaaattcatcagatggcgaatattatccccggtcacagcaaaatgggtaagcgacttacccgctttggttactgtgaggcgcaggctatgcagccaacgctattggcggtgcctggcgagatagtgcgcggccatgaatttcactactcagattttatccccgaaacacccgccgttatggcctgtcgtaaggttcgcgatggccgcgtgttacaagaatggactggcggctggcagacaggcaacacgtttgccagctatctgcacgtccatttcgcccagcgtccggaaatgttgcagcactggctggcggcggcgaggcgagtattatgacgatccttgcctggtgtatcgcctgggtgctggattttatcatcggcgaccctcaacactggccccatccggtacgctggataggccgattaattacgtttgtgcagcgtattgtgcgtcgctattgtcccggcgataaagcgctgcggattggcggcggcgtaatgtgggttgtggttgtcggggtgacctggggcgtggcatggggcgtactggcgctggcgcagcggattcacccctggtttggctggagcgtcgaagtctggatgatctttaccacgctggccggacgctctctggcccgcgccgcgcaggaggttgaacgaccgttgcgggagaacgaccttgcggaaagccgaataaaactctcctggatcgtcgggcgcgatacgtcgcaacttcagccagcgcagatctatcgcgccgtggtggaaacggttgcagaaaacaccgttgacggcattatcgcgccgctctttttcctctttctcggcggcgcgccgctggcgatggcctacaaagccgtcaataccctggattcaatggtgggctacaaacatgaaaaataccgggcgattggtatggtcagcgcccgtatggacgacgtagcgaactatttgcccgcccgactgagctggctgttgctgggcattgcggcaggactgtgtcgcctgagtggttggcgggcgctgcgtattggctggcgtgaccgttataaccacagtagcccaaattgcgcctggtcggaagcgtgtgtggctggcgccttaggaatccagctcggtggcccaaataactactttggcgagcgtgtggacaagccctggatcggcgacgcgcagcgcggtatttccgtggacgatatttcccgaacgattcgattgatgtgggtcgcttcaaccctggcgctggcgctgtttattgcggcgcggtgcgggttatctggcgtggcctgaggacgacagtatgcattatatccagcagccccaaaccattgaggccaacagtttcaccattattagcgacattattcgcgaaacgcgtcctgattaccgtttcgccagtccgctccatgaggccattatcaagcgggttattcataccaccgccgatttcgactggctggacattttgtggttctctgccgatgcgctggagcagctttgtgatgcgctacgccaaccgtgcattatttataccgataccacgatggcgctgtccggcattaataaaagattactggcgacgtttggcggcgagtgtcgctgttatatcagcgatccgcgcgtggtgggcgtaccggtaggctttgtcggcgcggcggagtccaaagaggcgctcacccatagccattttcccgcggttgccgcgttagggcgtaaaggcggcagtaacgtggctgccgctatcgtcaatgcgctgctctatcacctccgggaggcctgatgagcgagctttcttttgacgcgccggtctggcgccacggtaaagcgttacgtaaaggatataccaccggttcctgcgcgacggcggcggcaaaagtcgccgagctgatggtattacgtcaacatctgattcatcaggtctccatcgtcacgccgtcgggcgtcacgctatgcctgaacgtggagtcgccgcacattgaaggccagcaggcgatagccgcaattcgtaaagatggcggcgatgacgtggatgccacgcacgggatgctgatttttgcccgcgttacgctcaacgacagcggtgagattacgctcactggcggcgaaggtattggtacggtaacgcgtaaaggggttggactgccgctcgggagcgctgccatcaatcgtacgccgcgccataccattgaatctgcggtgcgcgaagcgataggcccggcgcgtggggctgatgtggagatttttgccccggaaggcgaagtgcgggcgcagaaaacctataactcgcggcttggcattcttggcggcatttccattattggcactaccggtattgtgacgccgatgtcggaagaaagctggaaacgctcgctatcgctggaactggagatcaaacgggcgtcaggattaacgcgggtgatactcgtgccgggcaaccacggcgaacggtttgttcgcgaacaaatgggcgtcgacacacaggcggtcgtcaccatgagcaattttgtcggctacatgattgaagaggcggtacggctgggattttgccagatagtgctggtgggtcatcctggaaaattgatcaaaatcgccgccgggatctttcatacccatagccatatcgccgatgcgcgcatggaaacgctggtcgcgcatttagctttactgggcgcgccgctggagttactcaccctggtcggcgattgcgataccactgaagcggcaatggagcacattgaagcatatggcttcgggcatatctataaccatcttgccaggcgtatttgtttgcgagtcatgcagatgctgcgttttaccaaaacgccgcctgtctgcgacgccatcctgttttcttttgataaccatattctcggcagtaatcgtcccgtcgacgagattgctaaggagctgcaatgctaacggtcgtgggaatggggcccgctggacggcatttgatgacgcctgcggcgctggaagcgatagaccacgccgatgcgctggcaggcggtaaacggcatttggcgcagtttccggcgtttggcggcgaacgatttacgctgggcgcggatattggcgcgttgttgtcatggattgccgcccgtcgggataaagggatcgtggtgctggcctccggcgatccgctgttttatggcatcggtacacgcctggtggcgcattttggtatcgaacaggttcgcattatccctggcatcagcgccgtacagtatctgtgcgcacaggctggaattgatatgaatgacatgtggttgaccagtagccacggtcgttgcgtcagcttcgagcagttggcgaaccatcgcaaagtggcgatggtcacggatgcccgctgcgggccgcgggaaatcgcgcgggaactggtcgcgcgtggtaaagggcatcgcttgatggtgattggtgaaaatctggcgatggaaaatgagcggatccactggctacccgtcagtgcggtcaacgccgactatgaaatgaatgcagtggtgatcctggatgaaagatgagctttttctgcgcggcgagaacgtgccaatgaccaaagaggcggtacgggcgctggcactgtcgaaacttgagctccaccgcgccagtcacctgattgacgtcggggcgggaacgggaagcgtctcaattgaagcggcgctgcaatttccttcgttgcaggtgacggctattgagcgtaatcctgccgcgctacggctgcttgatgagaatcgtcagcgctttgcctgcggcaatatcgatattctccccggcgaagcgccaatgaccataaccgggaaagccgatgcggtgtttatgggcggcagcggcgggcatctgacggcgctgattgactgggcgatgggccatctgcatcccggtggccgtctggtgatgacctttatcttgcaggaaaacctccatagcgcgctggcgcatcttgtgcacatcggcgcatgccgaatggactgtgtacagcttcagctttcatcgttaacgccgctgggggcgggacactatttcaaaccgaacaaccctgtttttgttatagcctgtcagaaggaagaaaaccatgtcagagacatttgatccacgctgtgtatggttcgtcggcgccgggccgggcgatcgcgagctgatcacgcttaaaggctaccgcctgctgcaacaggcgcaggtagttatctatgccggttcgctgatcaataccgaactgctggattactgccccgcgcaggcagaacgctacgacagcgccgaactgcatcttgagcagattatcgagctgatggccgcgggcgtgaaagcgggaaaaacggtggtgcggttgcaaacgggcgatgtctcgctgtacggctccgtgcgtgagcaaggcgaagagttaacccgccgtggtatcgactggcaggtagtgcctggcgtcagcgcgtttctcggcgctgcggcggagctgggtgtggaatataccgtaccggaggtatcgcagagtctcattattacccgtctggaagggcgtacgccagtaccggcgcgcgaacaactggaggcgttcgccagtcaccagacgtcgatggcgatttatctctccgttcagcgtattcatcgggtggcggaacgtctcattgccggcggttatccggcaactacgcctgtcgcagtcatctataaggctacctggccggaaagccagaccgttcgcggcacgttagcggatattagcgacaaagtacgtgatgctggcatccgtaagacggcgctaatcctggtcgggaattttctgggtaaggagtatcactactcaagactttatgcagcggactttagccatgaataccgtaaagcctgaatccattgcgttgttttgcctgacgcccggcggcgtggcgctggcaaagagactcgccgcgatgctgccgttaacctgctttaccagtgaaaaactgcgggaagagggatttattcccttcgatggcggattcgctaataccgcccggcaggcttttaccacttataccgcgcttatttttatcggcgcgaccggcattgccgttcgtgtcctggcgccgttagtgaacgacaagttcagcgatccggcggtggtcgtcattgatgaacgtggtcagcatgtcattagcctgctttccggtcatgcgggcggggccaatgccttgacgcgctacctggcaggaatgttaggcgccgatccggtgattaccacggcaacggatgtcaatgagatgtccgcgttggacaccttagctttccagcttaacgcccgcatgtccgatcttcgaacggcggtaaaaaccgttaaccagatgttggtcagtcatcaacgtgtggggttatggtgggatgccgaactaacggaagagatcggccagtgtgatattcgcggttttatccctgttgatgatttgcagcggttgcctgaactggatgcgcttatctgcgtctctttgcgtaatgacctccctgagcttcccgtactgcactggaaactggtgccccagcgcgtggtggcgggaattggctgtcgccgcgatacgccatttcccctgttagcgacattactggcgcgtcagcttgaagcgcagaaactcgatccgctggcgttaaaagcgattggcagcgtcacgctcaaaaaaggggagccggggcttattcagctcgcctcctgctgccgcgtgccttttaaaacctttaccgccgaagcgttgcgcgaattcgaacaccattttcccggttctggcttcgtcagaaaaacggtgggcgttggcagcgtatccggcccggctgcgtggttattaagccagggtcaattgttaggcgaaaccctgcgcgaacagggcgtcactattactttgggagtttcacactgatgttaagcgtaatcggaattggccctggctcacaggcaatgatgacgatggaggcgattgaggcgcttcaggcggcggaaatcgtcgtgggctacaaaacctatacccatctggttaaagcattcaccggcgacaaacaggtgatcaagaccggcatgtgtaaggaaattgaacgctgccaggcggctattgaactggcgcaggccgggcataacgtagcgctgattagcagcggcgacgccggtatttacggcatggcgggactggtgctggagctggtgagcaagcagaaactggacgtcgaggtgcggctcattcctggcatgaccgccagcatcgccgccgcctctttactgggcgcgccgctaatgcatgacttctgccatatcagcctcagcgacctgctgaccccgtggccggttattgaaaaacgcatcgttgccgccggagaggcagactttgttatctgtttttacaacccgcgcagccgcgggcgcgaagggcatctggcgcgcgcgtttgacctgcttgccgccagtaaaagcgcgcaaacgccggttggcgtggtgaaatccgccggacgtaagaaagaggaaaaatggctgaccacgctcggcgatatggattttgaaccggtagatatgaccagtctggtcatcgttggtaataaaacgacctatgttcaggatgggctgatgataacgccgcgaggttacacgctgtgaatgagggggaggtgctggtggtgggcggcaccagcgatgcgcgcgcgttatgccgacaactgggtgcggcgaacgtcgcgtacaccttatctgtggcgacgccagccggaaaagcgctggctggcgacattaaaggacaggtgcgctgtggtcgtctggagtacgggcagatggtcgcatggctaaaagaaaaccgtactcgctgggtaatagatgcgtcgcatccttatgcagaaatggtcagccataacctccttcgcgcctgtgaaacggcggacgtgttgttaagtcgttatcagcgtccggagcagcttagcaatctgacgcatccgcttctctatacggcgcgcagtattgccgatgcctgcgagatagcgaggcgttttggtccgcgcgtgttactgacgaccggcagtaaagatctggccgtctggcgtgccgggctggcggaaaaaacgttgctggcgcgcgtactgcccgtggcggaggtgattcaacgctgcagcgaactggggttcggcgttggagaaattttcgcactgtgtgggccgttcagcgctgattttaacgccgcgttttaccgccagtgccgggctgacgtggtcattaccaaagcgtccggcgcggagggggatatcaggaaaaagttcagccctgtctggatgcgggcattccctgcatcgttattgcgcgcccgacgccgctcgtgacgggtgatgagttactggaaagctaggccgcctttgcgcagcgtttatcgcgctggctggccgcagctaaggagtaaaaatgaaaaaagcgcttctggtggtcagttttggcaccagctatcacgacacctgtgaaaaaacattgtggcgtgcgaacgtgatctggcggagtcctgtcccgatcgcgacctgtttcgcgccttcacttccggaatgatcattcgcaagcttcgccagcgtgacggtatcgacatcgatacgccattacaggctttgcaaaagcttgcagcacagggatatcaggacgtggcgattcagtcgttgcacattattaacggcgacgaatatgaaaaaattgtccgtgaagtacaaatcttgcgtccgttatttactcgcctgacgctgggcgtgccgctgctgagcagccataacgattatgtgcagctaatgcaggcgttgcgacaacagatgccatcgctcagacaaacggagaaagtcgtttttatgggccacggcgccagccatcatgcattcgcagcttatgcctgcctcgatcatatgatgaccgcgcagcgcttcccggcgcgcgtcggcgctgtagaaagctacccggaggtcgacatcctgatcgacagcctgcgtgacgaaggcgtcaccggcatacatttgatgccattaatgctggtggcgggcgatcacgccataaatgatatggcttcagacgacggcgactcatggaaaatgcgctttaacgcggcgggcattccggcgacgccgtggctgagcgggctgggagaaaacccggctatccgggcgatgtttgtcgcgcatttgcaccaggcgctgaacatggcggtagaggaggcggcatgaacggtaaattatacgcattaagtaccgggccaggcgcgcccgacctgataaccgtccgcgcagcgcggattcttggctcgctggacattctgtatgcgcccgccggtcgtaaggggggcgatagtctggcgttgtcgattgtgcgcgactatctcggcgagcagacggaagtacgttgttgccatttccctatgagcgctgacggcgccgagaaagaagcggtctggaacgaggttgccgccgcgcttaccgcagaggtggaagcgggtaaacaggtcggttttattaccctgggcgatgcgatgctattcagtacctggatttttttactccagagaatcggctgcccggagtggctggagattgtccccggcgtcacgtccttcgccgcgatagccgcccgcgcgaaaatgccgctcgccatagaacggcaatcgctggcggttatttcttgtaccgcgccggaagcggaaatagcccaggcgctacaacagcatgatagcctggtgttgatgaaagtgtatggccgattcgcccgtattaaagcgttgctggcgcaggctggcctgctggaatgcgccttaatgatgtccgaggccacgctgcccggcgagcagtgctggcgccacctccacgaggtcaacgatgatcgagcgttgccctatttttcgaccattctggtcaataaacagtgggagtatgcagaatgaaacttgaacagcagcttagacagttgtctttcagtggactggctgcagcgctattgctgatggttgtcccgcaacaggcgtttgcgatgcatatcatggagggctttttaccgccagtgtgggcgctggcctggtggttactgtttttaccctgcttgtggtatgggctggtacgcttacggcgtattgtgcaggaggataatcatcagaaggtactgctggcgctgtgcggcgcgtttatttttgtcctgtcccgctcaaaattccgtcggtaacggggagttgttcacatccgaccggcgttggtctggcggttatcttgttcgggcctggggtggtggcgattctcggcgcggttgtgctgttgtttcaggcgctattgctggcgcacggcggcctgacgacgcttggcgcaaacggaatgtcgatggcggtgattggcccggttgtcggttatctggtgtggaaaatggcctgccgtgccggactgcgccgcgatgtcgccgtttttctgtgcgcgatgctggcggatttggcaacctattttgtgacttcagtccagcttggcgttgcgtttcccgatccccatgccggagcgacagggtctgttgtgaagtttatggggattttctgcctcacacagattcctgtcgctattgctgaaggtttattaaccgtcatgatttatgaccagttaaccaaacggcaagtgattaccgtacaaggacattaaaatgaaaaaaacgttgatgttgttagcgatggtggtggcgctggtgattctgccgttttttattaaccatggcggtgaatatggcggttcagacggcgaagcggaaagccagattcaggctcttgcgccgcagtataaaccttggtttcagccgttatatgaacccgccagcggtgaaattgaaagcctgctgtttacccttcagggctctcttggcgcggcggtgattttttatatcctggggtattgcaaaggtaaacaacgccgtgatgaccgggcttgatcgactcagctatcaaagccgctgggcacacgttgcgccgcagcgcaagtttttgctgtggctggcgatgatgatactggcgtttgttctgccgcctgtagggcagggcattgagctgctgatcattgccggattgagctgttggctattgcgcatatccctctggcgttggtgtcgatggatggcgataccttttggatttttgttggtcggcgtgataacgattatcttcagcatcagccgcgagccgcaaatgctgctggctggcatatctgttgggccgtactggatcgggattacccgtgcgggcgtggttacggcgaatgaaacgttctggcgtagcctgacggcgctgtccgcgacgttgtggctggtgatgaacctaccgtttccgcagttaattagcttgcttaagcgcgcgcatattccacgcctgcttaccgagcaaatcctgttaacgtggcgctttctctttattcttctggatgaggcggtggcaatccgtcgtgcgcaaacgctgcgttttggttattgcagcctgccgaacggctatcgatctctggcaatgctgactggactcctgtttacgcgggtgttaatgcgttatcagcaaatgaccaccacgctggatatcaaactgtatcagggtgattttcacctgtaaggactattatgcttgccacttcagacctgtggtttcgttatcaggatgagccggtacttaaagggttaaatctggatttttcgctctcgcctgttaccggtttggtgggcgcgaacggttgtgggaagtctacgctttttatgaacctgagcggcctgttgcgtccgcaaaaaggggccgtattgtggcagggaaaaccgttggattacagcaagcgcggactactggcgctgcgccagcaagttgcgacggtttttcaggaccctgaacagcagattttttatactgatatcgatagcgacattgcgtttagtttacgtaatttgggtgtgccggaggcggaaatcacgcgccgcgtcgacgaggcgctaacgctggttgacgcccaacattttcgccatcagcccattcagtgtttgagtcatggacaaaaaaaacgtgtggctatcgccggagcgctggtgctacaggcgcgctatctattgctggatgaacccactgctggtcttgatcccgcagggcgcactcagatgattgctatcatcaggcggattgtggcgcagggaaatcatgtcattatctccagccatgatatcgatcttatttatgaaattagcgatgccgtatacgtgttacgccagggccagatcctgatgcatggcgcgcctggcgaggttttcgcgtgtacggaagcgatggaacacgcggggctaacccagccctggctggtcaaacttcatactcaactgggactgccgctgtgtaaaacagaaacggagttttttcatcgaatgcaaaagtgcgcattcagggaggcgtcatgacgcaggcagttatgttgcaggggacggcatccgacgtcggcaaaagtgtgctggtggccggtttatgccgcattttttatcaggatggtctgcgtaccgcgccgtttaaatcgcaaaatatggcgcttaattctggtattacgccggatggtaaagagatggggcgggcgcagatttttcaggcggaagccgcggggatcacgccagatgtgcgtatgaatccggtgctgctcaaaccgaccagcgatcgccaggcgcaggtcgtgctgatggggaaagtggcgaccaatatggatgcggtgagttaccatgactataaaccgcgtttgcgtgagcaaatccttgcggtctataacagcctggcgcaggaatatgacgttattgtgctggaaggcgccggaagcccggcggaaatcaatctgcgcgatcgcgatatcgtcaatatgggaatggcggaaatggcccagtgtccggttattctggtggcggatatcgaccggggcggcgtattcgccgctatttatggcacgctggcgctactgcacaaacaggagcgtgacagagtaaagggcgtcattatcaacaaattccgcggcgacgtggcgctactctattccggtatcgaacaaatcgaatcgcttaccggcgtcccggttctgggagtgatgccatggctggatgtggatctggaagatgaagatggcgtcgcgctgcaaaacgataaatatcgcggtaacgccccccgtgatatcactattgccattgtgcaactgccacatatttctaactttacggattttaacgctctggcggcgcagccggatgtgcgcatacgctatattcgccgcccggaagcgttgactgacgctgatctggtgatcctgccgggcagtaagaatacgctgagcgacctcgcctggctgcgcgaaagcgggatggcggatgcggtattgcagacacatcggcagggcgtgccggtgatgggaatttgcggtggctaccagatgctgggcgacactattgtggatgaggtggagtcggggctgggtacgcagccgggcctgggactgcttaatacgatcactcgctttgcacaggataaaaccacgacgcaggttaacgcgacaatgtcaggcgagctgcccggctggctggctgccgcggcggggctaccggtacgcggttatgaaatccacatgggggaaacggtgctgcaggaaggatgctgtacggccatgacgttacagaaaaatggatgctctgtggcggatggcgcggtcaccgccgacggactggcgtttggcacttaccttcacggtctgtttgacagcgatgcctttacccgtgcggtggtcaatgggttacgggcgcgaaaagggcttgcgccgtgggaaacgactttttgttatgcggagcataaagcgcggcaatttgatctgctggcggaagcgatgcggcaacatattgatattgataaaatttacaccatcatgcaacagcatcaggagccggtatgatgattctggtgacgggcggggcgcgtagtggtaaaagccgtcatgctgaagccttaattagcgatgcgccgcaggtactgtatatcgccacctcgcagattcttgatgacgagatggcggcgagaattcagcatcataaagatggcaggccggcacactggcggaccgcagaatgctggcggcatcttgatacgttgattaccgcggatcttgcccctgacgacgcgattttgctggaatgtattaccaccatggtgacgaatctgctgtttgcgctgggaggcgaaaacgatcccgaacagtgggattacgcggcgatggagcgcgccattgacgatgaaattcagattttaattgcagcctgccagcgctgcccggcgaaagtggtactggtgacaaatgaagtgggaatggggatcgtcccggaaaaccgcctggcgcgccattttcgtgatattgccggtcgggtcaaccaacgactggcggcagcggcggatgaggtctggctggtggtctcaggtattggagtcaaaattaaatgagtaagctgttttgggccatgctcgcttttattagccgcttgcccgtgccgtcacgctggtcgcagggactggatttcgagcagtattcgcgtgggatcgtgatgtttccctttatcgggttgattctgggggggattagcggcctgattttcatcctcctgcaaccctggtgcggtattccgctcgcggcgttgttctgtattttggcgctggcgctgctgaccggtggttttcacctggatgggctggccgatacctgcgatggcattttttccgcgcgccgccgcgagcgaatgctggagattatgcgcgatagtcgtctgggaacccatggcgggctggcgcttatttttgtgctactggcaaaaattctggtggtcagcgaactggcgttacgtggaacgccaatgttggcggcgctggcggcggcctgtgcggccggacgcggcagcgctgttttattgatgtaccgtcatcgctacgcccgtgaagaggggcttggcaatgtatttatcggtaaagtcagcggacggcaaacctgcattactctgggattggcggtaatcgtcgccacggtattactgcttggtatgcaaggcctggccacaatggtggtcacactcgcggcgattttcatccttggccagttgcttaaacgtacgcttggcggtcaaaccggcgatacgctgggcgcggcgatcgaacttggcgaactgatctttctgctggctctgttatgagccgattattacggacgagacatcttatgcagacactacacgctttattccgtgacattcctgcgccggacgccgaggcgatggcgcgtgcgcagcaacatattgacggcctgctcaaaccgccgggtagcttgggcagactggaaaccttagccgttcagctcgcgggaatgccgggtcttaacggtacgccgcaggtaggtgaaaaggcggtgctggtgatgtgcgccgaccatggcgtctgggatgaaggcgtagcggtttcgcccaaaatcgtgacggcgattcaggcggcgaatatgacgcagggaacaaccggcgtatgtgtgcttgccgctcaggctggtgcaaaggtgcatgtcattgatgtcggtattgatgccgaacctattccgggcgtagttgatatgcgcgtcgcgcgcggctgcggaaatattgccgttggcccggcgatgagtcgctctcaggctgaggcgcttttgctggaggtttcccgctatacctgcgacctggcgaaacgcggcgtgaccttatttggcgttggggagctgggaatggcgaacactacgccagccgccgcgatggtcagcgtttttacaggaagtgatgcaaaagaggtggtggggattggcgcgaatcttccgccttcccgcatcgataataaagtagacgtcgtgcggcgggcgattgcgattaatcagcccaatccgcgcgacggcattgatgtgttgtcgaaggtgggggggtttgatctggtcgggatgaccggcgtgatgcttggcgcggcaaggtgtggcttacccgtattgctggatggctttctttcctactcggcagcgctggcggcctgtcagattgcgcctgcggtgagaccttatctgatcccgtcgcacttttcggcggaaaagggcgcccgcatcgcgctcgcgcatttgtctatggaaccctatttgcatatggcgatgcggttaggtgaaggaagcggcgcggcgctggcgatgccgatcgtggaagccgcgtgcgccatgttccacaatatgggggaattggcggccagtaatattgtcctgccggaggggaacgcaaacgcaacataacccgggcgcacaacaccagccatgtgagaaaaaagctatacttaacgcacacctgccgcgacaaaggaagggatataatgcgtcgtatcacacctttttttccgtttttcgtcttgttggtaagccatttctcgctggctataagctatccgttgccgcccgaaggcagtcgtctggtaggacagcctgtcacaatcgccgtacctcagaacaatactcagcccttagagtcatttgccgcccgctatggtcaggggttgagtaatatgcttgaagcgaatcccggcgtggatgtgtttttacctcagtctggttccacactggtagtgccgcagcagttgattctgcctgacaccgttcgtgaaggtattgtggtaaacgtcgccgagatgcgcctttattattatcccgcaggcacgaatacggttgaggtactacccattggtattggtcaggctggccgtgaaacgccgcgcaactgggtaactgcggttgaacgcaaacaagatggcccggtttgggtgccaacggctaatacgcgtcgggaatatgctaaagagggaaaaacgctgcccgcgatggtgcctgcggggccggataaccctatggggctatacgcaatatatatcggcaggttatatgccacccatggcactaacgctaactttggcattggccttcgcgtcagtcagggctgtatccgtttacgcaatgacgatattaaatatttattcgaccatgttcctgtaggaacccgcgttcagattatcgacaggcccgttaaattttcggtagagccggatggcagtcgttggctggaggtacacgaaccgctttctcgcaaccgtgctgaatttgagtcagacaaaaaagttccattgcccgttacgccagtgctgcgcacgtttatcaaaggggatgacgttgatacttcgcgggttaatgaggtgctggagcgccgttccggaatgccggtcaacattagcgcaggcaggtctggcctttaaatatcctgccacattgctggttttcatgggctggaacatctgtattagtagtgagtgtcatggcaggggcttcattttctcaacgaaccgcgaggccgccgattaagcccccaaaaactatggatgccaaaaagcccggaaaaccttatcaggtcaaccgggtaaagataagttcttattttttaaacgtctccggactcgcagggatatcccgaaactaaaatctggctcctctgactggactcgaaccagtgacatacggattaacagtccgccgttctaccgactgaactacagaggaatcgtgtggggtcgtatattagcggcggaaaaatttttgtcaaaccccatttaaccccttacagattcgattgcgggttatctcatcactttgttgcatttgcagacattttttctgcaaaaagctttgcagccttacgatttctcgctcattattgaaatgtggtttcaactctcttctttaaggtccattttgaacgtctccactgccttacgccaggttgtcgtccgtacgccctggtatgccaaacgcaagagctacaaagtgttgttctggcgtgaaatcaccccacttgctatccccatttttctggaaaatacctgtgttttgctaatgggcgtgctcagtacttttctcgtcagttggttgggcaaggaagcaatggcgggcgtggggcttgccgacagttttaatatggtaattatggctttttttgcggctatcgatcttggtactacggtggtggtcgcctttagcctcggcaagcgcgataggcgacgggcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtactgagttatccggctgcggcaattgcgctaatcggtagcggcgcgctgcgtggggcagggaatacgaaaatcccgttgatgattaacggcgggatgaacattctcaatattgtcatcagcagcatcctgatttacggggctttctcctggcaagggctgggttttgccggtgcggggctgggattaaccatttcgcgctacatcggcgcggtagcgattatttgggtgctgatgattggttttaatccggcgctgcgcattccgctgaaaagctatctgaagccgttgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaatctgccgggtaacgcccttggttcggcgtcgactattatcaccggtaagcgtcttggtaccgggcaaattggtcaggcagagcgtcaattgcgccatgtattctggatgtcgactatcgtacttacggcaatcgcctggggaacagcgccgttcgcgggtctgtttgcctcattttatacccaggagcaggacgtaaaagaggtagtgaaagttctgctctggcttaatgctgcctttatgccaatttgggctgccgcgtgggtgctgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaagagctttttgctgtgaaaatcatcaggaaacggtgaattttaaccgaagtgtggaataaagcagcaaacgaactttttttgtgaaaacaggctttgacaagccaggggcacctcgttaatattcgccccgttcacacgattcctctgtagttcagtcggtagaacggcggactgttaatccgtatgtcactggttcgagtccagtcagaggagccagattttagtttcgggacatcctggcgagtccggagacgtttaaaaaataagaacttatctttacccggttggcctgagaaggtctgccgggttttttgacatccatagtttttgggggcttaatcgggggcctcgcggttcgctgagaaaatggagcccccacctatggcattaaccgataccgctatccgcaagattaaacccgtatcagtatgctgacatatagaggtgttcgattcaaacggagcgatcacacaagcttgccaggtgatgcccctggtgggaatcgcgactgtctctttcatctgatttcagatatttcccgtgatcttgatccgttctttcccaaaagattgatttctttcattcgaaacaaggatgtacaataagtaaaccaaaatagtaactatagagtttctaatggatacagtagaagaactaaatggaacatacttctatgcaggaaaatccaatctgactgctgccgaacttctgttatgattttctgtgagaataccgcaagccagtttgggattggtgttgcagatttcggggctgttgttgctctggtatcaggtcgtaataatctttggacaagggcgaaacccgctggagcgactaaaggcacatcatacgcgtccaggactgcacgtgcagtgtttaaaaagtcaaaatttccctttggaatatcccttccgacatggttaggcggttacaccccgtggacagccagacgtgttatggttcgtaacattgcgccgtttgttggacgttccattcctttgatcggggaaattatccttgccgcagatgtgtcacaaatagcatatcgcactatacgcgactacaataccattgctcggggcaatgataagttatgctagacaatattgaacagcaagtttacgagcttgtacggccttatgctggcacatatctgttcaacattaagcaagtggaattaacaccagagattgaccttgatactgatctgagcattgatgaacttgaagccgaagatctcatgaataaattcttcgagaaactcaatgtcgagcgaggtaacttcagaatagaaacctattttcctaatcaccctttttcatggcatccgttcaagaaaacggagcctgtacccgtcccagatttcactatcagcatgctgatcgagtcagcaaaagccgggaaatggttatatgactaattgtaatgaacttaacaaatggctgtaccagtacccttctttttgagcgatgatggtggcgctaagatagttctcttttctttttaaagggttcatgtttactgccgccgcccttacgctaacccctttagtttcctcctttgctgtcatactatcgaatgacgtgcctcacctgtgaacgctaaggagaataatatggaaaataaaggcacaaacctgacacccgagcaggcgctggatcgcctggaggagctgtacgagcagtcggttaacgcgctccgtgaagccatcgctgactatgttgataacggcacgctgcccgatccccatgccaggcttaacggactgtttgtttatccttcgctgtctgtaagctgggatggcgcgacaccgaacccgcctaaaacacgcgcttttggacgctttactcatcccggctgttataccactaccgttacgcggcctgcgctatttcgcgcttatcttctggaacagcttaacctcgtttaccatgattatggcgcgcatattgcgatagaggcctcgcaccatgagatcccgtatccttatgtgatcgatggctcggctctgacgctggatcgttctatgagcgccgggctaacgcgccattttcctaccacagaactggcgcagattggcgatgagacggcagacggtctgttccaccccggcgaattctatccgttatcgcacttcgacgcgcgtcgtgttgacttctcgttggcccggttacggcactataccggtacgccggttgaacattttcagcccttcgttttgtttaccaactacacccgctatgtcgatgagtttgtgcgctggggatgcagccaaattcttgatcctgacagtccctatatcgcgctttcctgtgccggcggaatttggatcacggcagaaacggaagcgccggaagaggctatttccgatctggcctggaagaagcatcagatgcctgcctggcacctggtaacggcagatgggcaggggattacgctggtaaatatcggtgtcggcccttcaaatgctaaaacgatttgcgaccatttggccgtgctgcggcctgacgtctggcttatgattgggcactgtggagggttacgagaaagtcaggcgattggtgattatgtgctggcccatgcctacttacgcgatgatcatgtgctggatgctgttctgccgcctgatattccgattccaagcattgcggaagtacagcgtgcgctgtacgacgctaccaaagcggttagcggaatgcccggcgaagaggtgaaacagcgactgcgcacgggaacggtcgtcaccacggatgaccgtaactgggagcttcgttattccgcatctgcgctgcgattcaaccttagccgtgcggtcgcgattgatatggagagcgcgacgattgcagcccagggctatcgcttccgcgtgccttacggcacgctgctttgtgtttctgacaaacctttacacggtgaaattaaactgcccgggcaggcaaaccggttttatgagggggctatttcagaacatttgcaaattggtattcgtgctattgatttactacgcgcagaaggtgatcgtttgcactcacgtaaattacgcacgtttaatgagccgccgtttcgctaacgaaatgggctgtcgcctgctgttgggcaggagcggaagaggcatatttatgtgatatggaaagtggttgaatgaagccttagcgggaggtgattctgcatcccgctaaggccttattgtgccgcggcttcatcaccatcgccggagatctgtcgccgataatcgcgtctacgtcaggaaacgcgccggaaggcgaaaacattgcgccgcacttcacgctccttgagcgcctggacccacaagcccggattaacaagcagataccgaccgtgagaatcgatcagcttaaagggattatcagaaggcttgatactgaggattttcgcgttggacagggatatagggtggtcacgccattatcgaactgaaatggccccaaatcagaccaccaatttcaccggatgcgcaggtaaaaccagatacgcatcggtaaaggttttcacgctaacttattgaaacctaattaaatagggacttataagtacgcctgaaaacagaaatttggctcctctgactggactcgaacttcatctacatctcctgttattactgcttttgttaaacttagccatatttttaccaacatatttaccatcattattgttttcttgtggttaaaatgtcaattaaaaacaattggttgttgccataatcatctgactatacgtatctaaatttgctttcattatcaacatgatgttgtcgttattttttttaaaataaatgatgaaaaacaattggttattttttattaaataaatcatgtttagtcaaggtgaaagcactgacctccaaggtcacttactgtgctcacaccattttgaaaacccgctcctcttttccactttctctatcatgttgaatgggctaacgtttaggaaacacaaaagcaatcggtagaacaatgactacacaaaaggaaatggaagaaatcagggcagcgttatcttggtttgatgtacgccgatatgatggccttaaagacctcaccttagaacaaatctatgcagagcttgaaagacggatgttggcttacaaaacaagacaacaatgggaaacagcaggcaaagataatcaaatgcaagcgatataccatgatgccacaatccgatgtggtgatgtgatacttaaatcagactggatttcagacaatcacagactgtcgcatagctatgctgtaagaccaatgaccagagttcaattgttcaactatgggcgggctatgtatcggctggagacttcagagcaaacagaccctgttgcagtgagttccgactacatctctgagtatctgaaacaaggaggcatgaaccctgctaacaagatgctgattgaaattgacttggaagaagccagcagtgacgatctcgcagaacatctgaaagtactgattgctctatggcaaaagcacctgaaaacgcctaaacccccgaaacgaaaatttaggtttggtcataagacctttgaaagaatacttgattacaaagtcatccctttgatggatttgatctcatgggaacagctctacaacgaaggtaagaacatacctttcaccattttagctgacatcctgcatggtaataatggggtcagaagtagtgagaacatcaaagatactgattatgattacgcgaaaagttatcttgataacgatgagtacttcaaggttttaaatgatttctatattaaaaacaatatgttgaaggattggggtatcgttgatgtgataacacttaacgataaatcctcggataaaaacaaaaagtaaacacaagggatgttcacaacctgcgaacatccctaaaaagcgtatccctccaaaaatttccgcgaaactcacggttggtgaacatccctagtttagaaccagccaaaatcctagaattatctccatcgaacaacatactaaaaaacgaaatatccaagatattacgtaaaaaaaacaggagataatatggttcaaaacaaaacagataaacatccgaaactgattcgtttgccagaagtaaaaagaagaacagggtttggtaaaacgtggatatataccttaataagagcgggtaaatttcctaagcaagtaaaaaccggattgcgctctatagcatttattgaaagtgagattgatgaatggatttacaaaatcatttctgattctcgcaatcatatctaaaaaagtttattaaataatgagaggttaagatgaaaagtaaaaacgtactgccttgtgtggtgactgttacgaatgatgagacagaagtatttatggaaatggcaataaataactttagaaaacatcttcaggtcatgattgattgtatgggaaatgattacgagcgtcattttaaagaccggctttatattgaagaagtgattggaaaagtgatcgagcgaacaaaacgagagtttgctgaatcaatgaaagataataaagggaaagaatatcatctgttcttggatgaggtgagaaggaatctgagagttatttattctgcgtatcgtactaactattaatgagagaggtgaatatgaacgaaaaatgtttaggctggaatgaaatacccgttaaaatatccgcaagtaatgctgagacagcaaactttgctactgatgttgtaaatacctataacgagttaatacattacttatactttaatctaagtgatgatgaatttctgaaaaaaatgaaggatggattttacagggagatattcataatggatattattaatctcacgctacaggaatggtttgaaagtgctgaagagataaagattaaatacatatcagttccagaggttaaaaccatactaagtagttatcatgagtttttgattaaatgctttaatggtgatgattatcttctttattacaaaagaatagaaatcagcgcaaataaacagactgtaatataaaataagaggtaatgaaatgagtgaaaaactgataaaagaatctcaaaaagtatttatgcatatggcaggtttgttttatgaaatcaaaatgaatacgcttaaggaagtccgacccgatgaagcagagatgttaatggaggatgatgcattcatggatagtatttataaggattgtatcaaaaatgcaagcgcatcttttaaaaaggtagtcagatgggagtactttgaacaagggcattcagtaaaaatggttgataaggaggtggtgttgataacattacgtgttaatcacaaacgaagataaaaaggttatttaataaatcatttttagcctcattcatggggcgaaaaaaaagaaaacaaatatcatttaatagtgaggcgtaaccatgagtaaaatttttgaaattaaaagtgtatctacagaaacgttttataatattgcagagcgttcgtttgaggctagttggaaggttatgcaggatatggcctctgataatgtctcatacttggtatatgatgcggattttatgtgtgttttcatcggcaatgttattgagcatatcagtaaaaatttttacatcattatccaatgtgaatgtctggaaggaaagcttgaagaagtaaactttgaagaggtagcggaacgtctggtccggcattcatgggagttttgtaaataatatcaaaataaaaatagattaagaaatcatgggcagagttgttatctactcactgatttagattatgtggccccgtaatggggctgtacatcgattacaagaggaatatgatatgaatgatgtggtattatacgaaaaaaatgaatcaatgttttttgccatttgcacggtcttatcattatattgcgatttcatatacgaaatagcatatggatttcataatgaagcggtaatgatcattgaaaatgaaaagtgtgtgggacaggcacttaaaatacaaataaacaatctattcgatgatttcgattactacaaaaaagtgaatggaacagaaaaagtaaaacgggaagatatagatgaaaaagaactctttaacaaagtaatggcagcacataaccaaggagtaaaagcgctaatcatgaagaatcttgaggccaatcttcgagagaaagaggaaggttctgaatattggaagttaaaaatatttaataggtttaatgggatatagaagtcaatgtaggcttctatatattcagataaagaaagtagtcatgatctttatctcatcggagaaagtgtttttcatggctggatatttaaaaaattattttattttgtttttcattattttttcgacttcttttttttgtgatgtagataaattccttttaatctctttcattttgtttttaaaattaagattatctctttcatcatgcaaggacttcattttattatatgcttcgtcactgaaaggatgtaagttatcatctattttttcatctaagtaagaagaaaggaagcatctatcaaaataattttttctaagcgcatcgtaaattttagcactatcaataattgtttcatcttccggttctttttttatatggtctgtcatgttgactcctcttatttttagtggattgtgtatatattttattttaagggattggttcaaagtgtcaaatttaaatgttctttcaaaataacgttcaatggtattttgaagctttcaatgctggattatataagaatgatttacatgtttatttgaaaaatagctatcaacttaagtaccgggattcgggactttaactcccggaagtcggtacttgttttttagctataactggcctgagagcatttttttcttcattattcagttagtgaagatgagaacaactaatcatagatgctttaggaggcagttttactttttattgcattggtttcctctcttgaatttatatctcagcttagtgattgttaggaataatcactaagcgctgctgctgaaaatatagttttattatacgtttaagatcaaatatcataggttgtaaataacatgctacatttcaagatgtgatcattatcaattatcataaggaaataatctataacgaaactagaaaatttaaatttaccatataagttatacgctaaaacgaaataattgattcagtattagggcatagccgtgtgtaagtagtagatggaattttcaggaagaatgttttaaaaatacatgctcatattattttagcagtataaatgaatgtgattattgtaaccatgatgaaataaaaaataataaccctattataaaaagaggttgactgtctacaaatcgaataatatcataataactatttatgttattatgatattagttaaaaatggaaagaatatgaataaaagacttaatatgctatatgtcaacaacattaacgcattaaataattaccgtgaaaaacattcagataataacttacatggccccctccttttaaagctaaaaaattattttcatcagcataataaattgatggttataggacaggaaacctatggatggtgcaactctcccgatattaatgaacagcttgaaacatatgaggagttcgattttggcgtatcatattatagcagtccattctggaatatcataaggaaagtagagcgagcgcttggtattgaaccatatgcaattgcatggtcaaatctgaatcggtttgatgttgattgcggatcaccagattataccgagctagctagagatatatcatcgtttgattatatattaaaggaggaaattaatattcttactcctgatatatgtgttttcttcacaaatcataaatatgattatcgactaacgtctttatatgaagatttaatgtttgaaaacataaatggattgccagaaaaacatttcgtaagattataccatccagacctcccagaatatacgattagagcgcctcaccctaaaacaatcagaataaaaggatgggaaaatgatttcataaaatatatagaggctattaaatgattatgcagatgcgatcttattaatatgaataaacaaaattgtgttactaattgcataacagcaatataagttattctatagtttatctaggccacggcgtgtaggtggccttaaacgaggagtatgatttttatcatttattgttgaaacagtcggtataaaatccatgttattatctgcattgactcgttcgtgcttaggacggcttgggaaacgtcgaatctcatcaggtgttggtttgtaagtatcactgttaaacttagcttgtttctcatattcagcacgagaaacatgatgacctaatacttcatcaaagacatagttttcagcaatacgtttatcatgttctgtactgacaggatcatgcttaactctgcttgatctaggccatacaaatttttctttgaagaaatctatgacaagagttgtgaaacgtttgaaaatattatcctgacgtggagtagtcttatcctttctttcatggtcaggggcgcttctggatgccctgtttgggttttgagaggtggatgttttcagaatagtatttgtaccagaatcagaaatactgattgatggcggaatacaagcaacaaccttactgacttttgttttatcacggtaagatttgactccacgcaaacgagtatcaggagctggtgctaccagtaaaggtctttgttcttcatttgtagaagagctggatcgcgtttctggtaaaacaatttcttctggttcagcaagatgtgtaatcgtaaagcttctgacatcaacgacgatttcaagatcaagttcgctgaatgttttgtagacttcaacggcttcttgcttggcagcatcacgaacagcctgttctgcggctctttgctcttgagcagctttactgcgccatttggcactatggatacgtttcattgcagggcggtttgtttcagcggctttagcaagccatagcgcttgttcttcattgtccagagcagccgccgctttttctaatgcctcttcatgctgggcctgaagggaacgatggtcaatacgttctgatgaacctgcggcttcgagatagctgttagccatagatgcccatgactcacgccacaacacagacatttttctgtcgttccagcttctttcttttttaccaaaaccttccgggcctatggcttttaacgtcaacataacgtgagcatgtgggttgtcgctatcaagatcatgaaaagcgatgtcggcaatcatgcctttatcaacgaaatttttctgacaatactcaaggacaagttttttcttgtcgtcattgtttaactcggtgggaatagcaacatcgaaataacgggatgtttgaccattgttctggcgctcaactttttccacttcattccacaatgctgtagagtcttttacgatgtgttctggtgcgttagctggagctaatatgaaatgcccgtacaaatcagtacggcgactataatcataggtatcacctgttctttcatctgttatccttgtacgagcatgataggcagccttcgcaacggaagacctgccttctgaacgtttcacaattttaaaatcaagatgaaaaatagccatacaataaaaacaacctcaatataagtttaaatatcaaactaaaatataactctccaatgcgactatgctggttttagtttttcgcaagaaaaactctggtgttgacgttgaccttgtttccgaaggaaacggtgttagcctgcggcaggcaaccgtcggtagaccccacacactgcgtagcagtgtataggtgggcattgctttatttttatatctcctaaaggagctaaaaataacgacaatgtataaagcttttctatagttaaataataacgctagttttaatgtctgtgaaattaacggggctagattcggatgaacggctgaggtattacacgaatcttaatgattatggttttagagagcgcccgtaagggcaaaagagttaatttccctcccgccgtaaggcgggaaaagccaaatgcactaaaacagacttataacgacagtttttttaaaaaaatggatggtgtaggttcggacttaaaataagagtgaaaaagcaaagggtgaaaaataaaccataaggaaagagagtcaagtaacgtggggaatattagatgatttaggttaatgattttgattgtatatgttgcatgattacatatagagcttgttgcatttttgtgcagagtcttgtaaacaccatttttgttatcaccttttgtatcataaccattttagttattgctgattaaacagtaaaaataaaataaaaatccatgagatcatatgttaaatgtgttttttgacgaaatatatttaagtttgtctggtcttttttatttttaataaagttaggttgttttatttgacaagtaaaatgttgtgttgtaaataaaataaagatacaaaaaaagccaactttcaaagttgactttttaaggactaaaaaagttttgccgacttttgaagccttgtaatcagttagaggaataacgtgattacaaatataataaagtattaaataatcttttcatatttgtcaaatctaaatctcaactttttacaagcctttcaaataccatttccaaaaacattttagtcttcaaaagcaataacgttaaacctgtgtatcaggtctaagaatctttggacatcatgtgttaaaaactgttttgttcttaggttattgtaggtggcatataaacggggggaagtcggtagccaccaacttgaagcgttcatctaaaatctataaagcggtagtataattttctttagtaaaacgagaaaatgctttaaatgatcatgatgtatccgtaggagtccgatggggtgtcccagtaatggaaaccgtgctggaactcaatagctacggtgagaatcgccaaccctgcgaacctaaaaaaaatattacaatagtatttttttacggggggttaggggggtgaagcttgcagaaaaactaagttttcctgacggaaaactactacgactgaaagtcgctatctaaaaccccagaacctaatctaataaaattctagtactactagtacaaaaaaataattttaaaaatatcagtaggtaggtgccatttcatcaaggcactaacgaaagataagtaggcttataaattaaatatggtgcatggattaatttgagttttttgttttttaattgtattaattaaaaaatataaataaaaaggtaatgatatggaaagtaaaacaaaaaaactaagaatgggatggatacaaaatcttactgagaatgaaaaaaagataatagatgattttctggaagaagccgctaagttaaaaggtaaagcactaaataaaaaagaaaaacaaactgtcaaatttattgctcgtgatcaagtccgctcgattagaaaagagcaaaaatcaaaaaaacaaaagaagagtagagttgatatggaagaaaaagaagatgaaacaattaataccatttcaaataatgcggatgagcaaggaagattaaagatactatcagctaaagaaagagattttatcaataatgccatatatgaagaaatgaaaattaaaggtagaaagcttgtaaaatgtgaaatgaaagaagttttaaaaattgctcgaaaaaagatcctcaacaatcgtatatcttgtcagatcaaaaatgaaagaaataaagaaaggtttgaggcagagtttgaatggagaaaaccagtgccatttcgtcgttaaagcattcattaatgatgatattataattttttataagaggtaatacatgaaaaaattgaaaacaaaaaaattgaaagaaagtgagtttataagatatatagaaaacaatcctgttgtctcaaaggctttatgcgaggaatatggaatctgtactgaaacaattgcctatgcattatatgttcatagcaataacttctttcttaaaaacgactacgttcaggatgacattcactatgatatagttaaaaacaatttaataataatgaaacccacgcttagacaatattatagaagaacaaggcaagtagattataacggatatacttttttatcaggtattaaagaatatcaagactattgtattttgttgacgctttgctgctatcattggatagctgatgtatttactgtctataatcatagtgaaagaagtcaatttatcgttgatgttgccaatgatcttctgaaaaggagtatagatcatttttcagtagagcatgagaatgttatcaactgctttaatatgttaaaagaaaagctcccatcgtataaaaagaaataataatccaatttttcaaatatcctcattgactaacatatatataagaaatatatatgtatcatggaactataagaggatagaaaatgagtgatatttcagataaagagcaaaccagaaagaaaccacgaataaaaaagacactggagcagcaattagcatctgctcagatgcgtttaaatcgtttgcaatataagtctaagaaagaagctaaacagatagaaacacgtcagaaaataattttaggggctgaagttgccaaggctcttgattgtgatgtttttacggtggataaggatcttgttttaggtatgctactagagatacctcacctacatccagatgataaagaaagatttaaaagaagcggaatgttatttctggcgagcatgaaaggaaggaaaacttgataatgcatataaactatttgacaagtattttaggaaaagttccaacagataattatcgttaactttcattaaaagatttgacattctatttatgatgatatatctatttatttaaaatctcataatcttatataatcagattctttcatctataaaatcataaaaatataattttaggtttatatatttcacgtcctgacaaatctctagcttaattttaatatggctggggatttgtttttatctgtatcttgatttttgtttgttatttgataattaattaatacgtgaatataaaaatggcgatgaaaatgaaaaaacaaaataaaaaagggttctcattacttgaactcattttggtgctgggtgtcggtagtatgatggcttttatgcgttttcaggatatgaaaactgaacaagaaaatgttatggctaaggctgttggtcaacagatgaagcagataggtgaggcggtaaatggctatatcaatatcagatatgacaagctttctacgctgacgtcaagcagtagtcagtcaagcgatccgggtccccgtacttgtaatggttcaggttgtgaaataacgtatcaaacattaatcaatgaaggattattaccaacagcttacactggtataaacgttaaaaaatctccatataaaatactattaaaacgtgatggaactgctcctaactatgttattaatggtcttataacgacatcgacggcatggattgaaggcggtaaaacacgttatgatttattagggaatgccatgcaaacagcaggtatagatagcggtatgactaaaacaacatctattgcttctgggtatagtggtcaatggacagaaacgtctgctaattttaataatatcacatccactggacaattagcatttagagttggttttaatagtgcgttatattctgtatatttaagacgggatggaaccttgcccatgactggcgatctaaatcttgacggacataatattaacaatatcgctaatatcaatgctacaggaaatattacgacgacaagcgacctacaggcaagaaatattaaagctacaggaaaagttgatgctgacggtgatatttcatcaggaagatatttgattgctaaaagcaaagatgaagatgcatcaataaaaattggaggcgatggcactggaaatcataattttatgtttgaatctcaaaaaagaacatctgttgttttttttccaagcgttaattctgcattgttaacttataaatttcgtgggaatataaacatattaagtccttctggggattcagttggtgttaaattaaatggcaccactggaaatatcactgcctctggaaacatagaggccgcccaaaatgtcaaaggcgctacattagaatccactggacgcgctacggtgggtgagtttgttcaattgaacggacaggctgaggttggaaaagtgtgtcaatctaatggattacaaggaagaacagcaaaagggaaaattttatcttgtgttaatggtgtatggaccggatcggttcaaataaataatagtcaatgtaaatggttttccccggctaatgctttttcatactttggagaatacagtgggcaacttcatgaaaaacctataatttgtccagcaggatatattatgacaggatctaaaatgtggggatgggcagaagatgttgatgacgaacatgttgatatctattgctgtcctttatcctaattaaaaaaggttaaaagttaaatcccatattcataaaagattttctgaggatgggattaccatagctactcttactcacggaagaaaaaaagctgaaatgtgtattttttatattttaattttgtgagttataaactggcctcctaaaaggccagtttatataatttaaaggttgctcattatttctgtaatggctgtggctcgaacatattttgctgcattagtcgcttaaattttaactgttgatgaaatgagaaattacccggttcttgaggataatcaggaaatatatttgtctaagaaaagtgaaaaaatttctgagccaccacctttcgggtgggttatcatgaaatgtaagtgagttattcatcatgatattgtaaggctagacaactatatcttaatattttgagtctggaatgtttttggtactaaatgtgtcgttaaagataataatcatttgacaaataatagcgattataataaggaatgttaaatagttacaaaggagataagatgaatatttttgacgataatgattacgaaaaagcctgtaaatggtataagcatatcagatctaatgttgaaggttttaatgttaaaatagaaaagttaagagaaaaaacagcattggatttattaaataatgaaggtgttgattattttcataaaggttatcaatcgtttgttgagcgctttgaaaaagtttttatcaaatcatttttggctccttatttaaaggggcctttttattcatctattggtatttattcttctatatatagttcttcttccatcttgatttttgtttgttatttgataattaattaatacgtgaatataaaaatggcgatgaaaatgaaaattaaaaaaggattctctttattagagttaactcttgttttaggtgttgggacgatggtggcttttatgaagtttcaggatatgaaaaatgaacaggagagtataatggcttctgctgtcggtcaacaaatgaaacagatcggtgaagcagttaatggctatataaatatccgttatgataaattatcaaccttatccaatgctgccggaacaggaaccgatccgggtccaagaacctgttcaggttcagtatgtgaaattacttaccagacattgattaacgaaggtttgctactttcaacctacacaggcactaatgctaataaatcctcgtataaaatcatattaaaacgagatggaacttcacctaactatgttattaatggtcttataacgacatcgacggcatggattgaaggcggaaaaacacgttatgatttattagggaaagccatgcaaacagcaggtatagatagcggtatgactaaaacaacatctattgcttctgggcatagtggtcaatggtcagaaacgtctgctaattttaataatattacatccgctggacagttagcatttagagttggttttaatagtgcgttatattctgtatatttaagacgggatggaaccttgcccatgactggcgatctaaatcttgacggacacaatatcaacaatgtcgccgcacttaatgccactggcaacattacgacgacaggtgacgtacaggcaagaaacattaaggctactggaaaaattgatgcggacggtaatatctcagccggtaattggatgtgggctaagaatggatatggggacgctataggttttggtggagatggatattctggaggtttaggtcgagattatgaaataaaaatgctatctaaccatccactaacgatacattcaccaacgtctagtcgcggaaatgatgttatattagatattgatggaaatatgagggttcagactgatattagctctcttagaaacattacagcctctggaaacatagaatcatcccaaaacgtcaaaggcgctacattagaatccacaggacgcgctacggtgggtgaatttgttcaattgaacggacaggctgaggttggcaaagaatgtcaatctaatggattacaaggaagaacagcagaagggaaaattttatcttgtgttaatggtgtatgggaaactatagatgctaatttaaaaatatcaacatacagtttaaagcctccaaaacatcaacttaatatgggagttcatagtgtatgctctttaagtaatgtaaaattttataaagggaataacactccatatattagctgtgaaataataaaaaatggaaataattggctttttcagacagtttattcaacacaatgtgaggctgtatgcataaactaaatcccataattactccgcgtcacgttcgattgaatggaaaaatcccagatcttttcttttttcttttaaaagactgacatggtaattttatattacatatggagtgttggttattctattatataacattaaaaagagtggatattaaaataaaaaagtgaagtatataattttataatctcaaactatagagaaataatctggaaattgtttcataaatattaaatcccatattcataaatattttcagagaatggggttaccatagctgctcctacttacggaagaaaaaatgctgaaatgtgtttttttagatttttattttgtgaattataaaatggcctcctaaaaggccattttatataatttaaaggctgctcattatttctgtaatggctgtggctcgaacatattttgctgcattgattttttctgcttttaaagcactaaaatgcgcagttccacaggctatcttcgcatcttcttcatgaccaagaccaatgtgtttactttttgtctctacaacaaagtaaatatgttcttcaccattgtcttcaataactaacgcccagtcaggattgtaggttcccagtggcgtcgggattttaaaccatcccggcagcttcacataaagcttaacttcatcctgttcttcgagttcctgagcgaaacggctttcgacttcagaatctttaggaacgtattcgtaaactgacttagacgaggtttcaaaaagattacgggcatatcctgttagctctttatccataaagagactttgcgcatacacctctccttttagtggataatatttaataccatcaacaattgacaggcgtttgcagtagttgattcggcctatagcttcactgataaactgctgtggatttttagcaaaatcagcgagtcttccactctctttcaggatggtgcttaaactgcgtcttgtcagtccggttttttcctgtagaacaccaagaatatctggcaatggctgctctgcaacatcaactacagagcttgttgttccattagacagagctttaacatcaaggccagattgactttgtttgattgttgctttgctgaaactgaccattgcttttgctacaggctgcatttcagaaagtgatttcgtacaggatttgatcaattcttcttcatcaaatgctagccgatacagcgttttttgacaaatgcgctgccataacgcttcgaattccgggctgtttaagacttctttccggtatttgattgttttacgttcatcagcattgtttatattgagtcgccctgctgatttacgcaggatagtttcaatttgttcctgtagtgaggcatacttctcactaacaacaaaagtgttttcgaataattcttttttcagggttttggtaatttttcccgatttttcaatataaccttcagtctgaagttcagaccagatatcatgtgaaccggaaatacctaaaccttgtgaggaatcagcgaagataagatgggcgaacgcatctttttcaatcacaccaaaacgtatgcctgtttcgctctcaatttcagactgtaatcgttcagcgtaggcttcataattttcactggcaacgactgtcagaatgttaatgctgtcatcacgaacacgttcaccctcttggttaacacacaggcgaagaccacggcctaatgtttgacgacgttctcgttcacttcccatctctcggaggctacagatctggaatacattggggttatcccagccttctttcaaagcagagtgcgaaaaaataaacctcactggattcgagaaactcaaaagcttctctttatttttcataatgagattataaccacgctcagcattttcacggcctgtattattgctttcgcttgtttcagcccatgcaccttttttatcaatggagaaataaccatcatgaacatctttggcatgttctggatgagaaggaagtaaatctttataggcagggcttttgattgctttaagatattcttcttcaaagatacgggcatattcacccggttcacgtactccttcttcattggtctgacgatataaatcaaccttatcaatgaaaaacagggtaagaaccttgatttgctgagtattcaggcgaagttctttatccagatgttcacggattgtacgtctgatcatatgacgctggatgagcatagggtcaatatcccccacgacatcaccgactttcatatagtaggtatcagaaggtgtttccagtgtaagataaccctctttgccagttcggatctcgcttatccggtaaccctgataaatatcacgtcctgtttcgtcatcgagtgtcataccgtcatatacggtaatctctgaacgatttacgttcccttttttatcggctatatcaacaataacagtcgcactaatgctattcttcttattgttaatactgaccagttttacataggggctattacttgcattttggacttcaagcccggcaacctcgatctgtttgaccagtttttggttgtaagcatcaatggcgtcaaggcggtacaccatatgatgtttatgaacatgtgttgctgaatagcgtaaggtgaacatggggtgcatagcatcaagtgcggttttacccgcaccgttcaagccaccatcaacactttgcggttcatcgacaataataattggacgtgtagcacggattaaatcaatgggcttatccagatcgtccacagttgttttttcactggactgatagagcttgttaacatcttttttgttaatcgcacccacagtcattaccatgatctgcataacagaactggttgcaaaatttcgaacatccgcaggttttgccgaatcatacagatagtattcgtatggaactcccgcaaacaggcttttaaaatgttcttcagttatttgtagtgttttataaacgccttccttgatagcaactgaaggaaccacaataataaatttactcatgccatagcgtttattcagctccagcatggtgcgaagataaacatacgttttacctgtccctgtttccatttcgacagtaaaatcatggctgtcgagcacaggtgaaggtggaagctggttttttaactgaacattgttcagatttttaagcagtacatcatcttcgggtatttgtgggttaacaggcattgaacctgttgcgccttcaaatgagagtgcaccctgagctggggccagcacagtcatttcgctttcccatttctcttgcccttcaaacaaatcacagaccgatgttatggcgttttgctgataggtaaggtcagattcaaaatgtagtttcatctcattcccttacaggctgtgcaggttagtcaggccatgttgttccagaatggcgcaaagatttgttttagcaacgttattttcaaatgcgtcatcaaggaaatagcagaccgtatctttgccagcttttaaactcttataccagtcgatgatccccttggtcagttcttctactgaagatgcagggatttgtttagcaaagcaggtaaacaatttgccaccgtcaacacaagaaacggttaatccatcaaactgacgggtttcaatgtttacactcaggtcaatgccacgtttgagcatcaactctgtgagcagatcttcttcattacggccttcaaggattgggcttacataggcatcaatctgttctgaaagggtttctgctgtggcttcccacggacggatattagatgtatcgagtttgaaaacacgaaaaccaacatcaccattccagtcaggattatcttcacgaacctttttacctgcacggcgtaggcgctcttttgtgatttctgatatttttaaagacattccatgcttcttcaaaaaagctgctgcaatggcttgttccttagtgttttcgtcaactaattctggtagttgcgcaatcacaaatttgattttcctattcttaattgcattggctgtgaaaacagcgtgaccaaaagttcctgaaccgccaaaaaaatcaagtgctatgcattcctcattagggtaagtagctatttctattatgcgaagaagagtgcctaaaggttttggtctagaaaaaacttctttgtcgaatccaatttcaataaattgttcacttcctctttcactatttacgtctctatgtgtccatgaggaggtggcttttaccgcatcccttttggatagatagtctttctccatgatgccccacatttttttagtaggcataaatttagcgtatacactctcgatttttgtttttgctgtatcaaatccccatctccatcggccatccgtaccatcatctcgaataggttttatttcgataagaccatcatttttttgatctttagagacagataatttgttttttacttcatcatagtagaaataataaaacatatcaggtcgatcttgtcttcggtccgcatcacctgttttacgtaaatccatatcacgaaagacttcacctgcttcatcaatcttattatatctttttaggattttatcatcaggttcaaacccataagttttagcatgggttatattttttgtcattacaagtatatattcatgagcagttgctatgaatttatcatcagagcgacctttaggattgtttgtattagctataagagctataaaattctcttctccaaatatctcaaaacataaactacataagttatggacttcatgttcgtcgattgaaataaaaataaagccagagtcagaaagtaagtttctggctaattttatacgggggtacatcatattcaaccaatcggtatgataacgaccactggtttctgcatttgtacttacccggacaccttcttctgtttgccctgtgatttcaagataatttttcatattatcttggaagttatcaggataaacaaaatctttcccggtgttgtaaggaggatcaatatatataagcttaacttttccagtgtagcttttttgaagaagctttaacacttcaaggttatcaccctcgatcatgaggttcttggtgttatcccaatcaacgctttcatctttacatgggcgtaaggtgccacgggaaggggtaagagcaagctgacgagcctgacgcttaccatgccagttcaggccatagcgttcttctttttcgtctacattttcacccaaaagctgttttaaaacgtcaaaatcaatgccgttttcattaaaggcttcaggaaacaatgatttaagcttggtgatgttatcagcagtgatattcattgattgcagttcgggcatttcaggcgaaagtttgttcattgaccattccacgtatctgtatcaggttactgtgtgatgggggatattttacggtaaagagtgcatttcatcaatgaacagcgtgctacagatttctttttaaatcattatgttaatgcttttattgaatgttctgtcctcgtgttagtacaattagcttttctgcgtctaccaaacattatcaggatgtgatgatggctaaactgaacaagaaacaactttctttactcaaggaaatgcctgcagaacaactcatgcaaataatttgtgatattgcagaggataatggtcaggcaaaatcctttcttattaatgaatatctgttaactccagaagaatcactgaaaaaggctgaggctgaatacaaaagggtaattaaaacaaaacgcttttatgattattatgaagcagcgattttttttgaggggctatacaggaatgtcatatttccacttgaaaagacggtatcaacgctgcctgaaaaaaccgaggcgttttgccatgatttactgctctcatttgataaagtcagcgaaattgctgatacatcagatggatcatggatggactattataatggtgctgtcgaaatatggttaaaatccctgtccctacaaaaagacaaaagtattgatgttatagcggataaaataatttccgtacttaaaggtgatgtgtattttaactttgatatttttgataagtataaaaaagaactgggatacaatgttattcgtgttttaagggaaagtcttcttaagacaggtgatgtcaatggtgctgttgagttaagtctgtatatcagggatgttgatttcatcaggcaatgctttgagaaaagaaaactgaatcagccagaatatatcattaagtttgctgagttgctggttgatgaactgtgtactgaggaggccattcaggttctcaataaaatcaaagaagataaatcagttgatcaggcagggcttcgtgataaatggactgaggtgttggctctggcgttgattgaagaaggcgagattcagcaggcaaaaacaatttgtatagacggatttaagaacaggtgtgatgttattttttataatatctataatctggtggagaaaaataatgactcactggatttgttctctggcatagcaaagaaaaaaggctttccgtttgttattcttttcttgtccgggacagatagttatggaaaacttgattctgaagtcatgaatgcgagtgaaaatgaaatcgcagagatgatgtctttattacgcggttcttttgttcgtaccttatcgagtgagctttacaggcatggttatgcatgttctgcaactctgctccgtagagtgctggcagaggacagtatcagtcgttctcagagtaaatactacacctatgcggcatctgatatgaaaaaaagcattgattacagtaaagatattgcatggactgaaaaaatcccttcaacagaagagtatttaaaatctctgtttattgagcacaaaagaaaatacgcactctgggaaataatgctggaaaaaatcgctggtttagcgatagagaaagattcagtatcatattcagcatagactgtaattaagcatgaagttgaaaggccgcgaacggcctttccctttatttatttgaatcaaactcaaacggcctgaccatatcgttgctgttagcatcaaggaaatcagcccaccactggagcatcaggcggcgctggtcaaggtgttttgccttgtgggtataagcagcacggacgctattgctttccttatggctcatttgaagctctacagcgtcttctgaccatagcccggactcaattaaggcactacaggccagagtgcggaaaccgtgtccacagatgtcctgctttgtgtcatagcccatattgcgaagcgctttgttgatggtgttttcgctcatgggtttaaacgagtcataacaaccagtaaagattaatccgtcatcatgaccttcttcataagtcagttgtcggatctctttgagtatcttcatggcctgcttacaaaggggaactaagtgcttacgcttcattttagccccacgagttgaatgtttgacgttttcaatcgcttcacgctgttcgggtatcacccataacttacttttgaaatcaatttctgaccagcgagcgaaacgcagctcactggaacgaatgaaaatcatcagattgagctgtattgccagtatggttaacctgcggcctttgtattcggcaattttgttcagtaactggggtatttcttccagctcaagtgcagggcggtgttcagtttgtggtttctgaactgcaccttccatatcataggctgggttatggcgtatcagcttttgctggacggcatgacgcaggattgccgtaatgtattgttgaatgcgcatggcaacttcaagataaccaagagcctcaacttttttcaccggaaccagcagatcacccgtatccagttcggcaacatctttgtcaccgattaccgggaagacataagtttcaaggcgcttccatacggcatcaccataatcatcagaccattttgttttcgtggagaaccacgctttggctactgttctgaaggagcgtgtattatcacgtttggctttaagctctttaacctctgcctgtttctttgcattagggtcaataccctgagcaagaagccttctggcctcatcacggcgctgtcttgcgtcagaaagagaaacagcagggtaaacaccaatagagaagagtttttgtttcccttcgaagcggtaagccatttgccagtatttcgaacctttaggggtaacacgaaggaacataccaaagccatcagtaagcttgtattccttctcaaggggttttgcattttttgctttaatatcagtcagtgacatgaaaacaccccctcatttgttggtaaaagggaaatcgaaccagcattaccagcatttttaccatcaaaatgatatggcttcgagtggtttttagtgaacgagggtgaacgactgagaggggataaccaattgatagaaatgcagaaagcagacgttagtgaacgtctgctttcttgaaaatggctcctctgactggactcgaaccagtgacatacggattaacagtccgccgttctaccgactgaactacagaggaatcgtgtgaacggggcgcatagtaacgatgtgcgatcggcttgtcaaagggggaaataagattgcgcgtttgtttgctgacaaaaacaacaaagcgttgaagttttgatctaattcctactttgccccggcatggcgcaactttgtctgtcattgcacaagtcaaatgctgtgaccttaccgcaatggctatgtaccagcgcctgatgaggcgtgaaaaattggcaggcacttggcaaataattctgagacataacgccgtagagattaagggcagggggcagaatgaactttagacgtgaaatattttgtgaaaatggttgatacaggcagtctgacgccggtagcggaaatggcagataaatttctggtgcaggcgaaaagatttccgtcaatatcacaggcagaattatggcaaaccagctttaccagcaaaagggtatggcttcgagtggtttttagtaaacgagagtaaacttgaagaaggggataatcagttgatataaatgcagaaagcagacgtcagtgaacgtctgctttcctaaatctggctcctctgactggactcgaaccagtgacatacggattaacagtccgccgttctaccgactgaactacagaggaattgtttcaacgaggcgttgaatactgggccggctataacgtgtcaacagtaaaattaacgcgccaattcaattggttaattaacccacaaagtgaggaattaatgttcggattcctcgccgtagtcgccttcggcagcgcttacccgtaagcgctgagaaggatcctggcgatagaactggcaaaaacgctgccatagcgccgggaaacgtggagcaaacagttctggcgcgctgaaaaaatactctgacaacacggcaaaacattctgcagggtcggtggcggcataggcatctatactggcagcgctttcgccaacaagatcgatttcatcctgaatattattcattgccgcgtggagatcgtgttcccagccagccacatcgcgtaacgggatgaaagggatgccgctggcgcgatcgccattacgcatatccagtttgtgcgcaacttcatgaataatgaggttgaaacccgaagcatcgaacgagtcctgggtatccagccagttcagaatgatgggcccttgttgccagctttgccccgactgtacgacacgctggctgtgcaccagacctatgtcatcttcccattcatcatctaccacaaagggcgcgggataaatgagcacttcatgaaaaccatcaagccactcaataccgagctccaggatcggtaagcaaaaaattaacgcaatacgtgcactttttaacgagtcgagctcaaatccctgtagcgctaccagtcttttctgctgcaaaaaacgttcggctagcgcaataagccgagcctgttcttgcgcggtgaggtttaccagaagaggtatagccagcgcatcatcccacggccagtcttcgttctgggttatttcttgtgctttccagggccacttaatcatcgttttgctcgtaaactcgtcacttgaacaaaattacccgaatagggtctgttaaaatgccaaattacctggcatcattgcaatatacggagagatgccggagcggctgaacggaccggtctcgaaaaccggagtaggggcaactctaccgggggttcaaatccccctctctccgccacaattcaaacacttagctcatcttctttcagcgatcagtctcacacttagaatacacttagagtattctgttagaatattacgtgaaaaacgtatcgccatcttatgctttttctgccagaagagggggccagggatggtgttatttttacttttcgatcataagtcaactcctggttttctgccccgctatttcgctgtaccccatcgggattcacagtgatgtcacttgcggcgacttaacgccgtcgtcctcggtaatcgtcgcacccggcctgttgcccgaaatgttcccctgtagacatgggcgccgggcagaagattaattgctgtcagggaaacgcgctggcgcgtggcgataacttacgctgcgggactgtcgacgctgtacagaaaatctggcctccagactggcttaaatatgcacacatgacaatacaaccggaaaatttacaaaacgcataatttgaactgagagagaaacttacaaacgaagcgacgaagatttaaacagtcgtagcgactccggtatcttgcgcgcatgttcaaataacactactgtatataaaaacagtattcgaggtatggattatggaatttttcagacctacagagttgcgcgaaattattcctctcccatttttcagttacttagtgccgtgtggattccccagccccgcggcggactatattgagcagcgtatcgatcttaatgagttgctcgtttctcatcccagctcaacatattttgtcaaagcaacgggggattcaatgattgaagcaggcatcagcgacggtgacctgctggtggtggatagctcacggaacgctgaccacggtgacattgtaattgcggcaattgaaggagagttcaccgtaaagcggttgcagttgcgtccgacagtgcagttaatccccatgaacggcgcctatcgacccatacctgtcggcagtgaagacacgctcgacatattcggggtggtgacctttatcattaaagcggtcagttgattatgttcgcgctctgcgatgttaatagcttttacgcctcctgcgaaacggtctttcgtcctgatttatgtggccgaccggtggtggtgttatcaaacaatgatggctgcgttatcgcgtgtagcgccgaggcgaaacaactcggtatcgcagcaggtgagccatacttcaaacagaaagaacgcttccggcgatccggtgttgtttgcttcagcagtaattacgagctttacgctgatatgtcgaaccaggtaatgaccacactagaggagatggtgccgcgggtagaaatttacagcattgatgaggctttttgtgatctgacgggggtacgaaactgccgggatctgacagatttcgggcacgagataagagcgacggtcctgaagcgcacgcacctgactgtcggtgtaggcattgcccagacgaaaacccttgccaagctggctaaccatgctgcgaaaaagtggcagcgccagaccgacggggtggttgacctgtcgaacatcgatcgccagcgtcggctgctggccctgatacccgtagaggatgtctggggtgtcggcagacgcatcagtaagaagctcaatgccctgggcatcaagactgctctcgatctctctgaacaaagtacctggatcatcaggaaacacttcaatgtcgtgctggagcgtaccgtgagagagcttcgcggagagccatgtctggagcttgaagagtttgcgccggcaaagcaggaaatcgtttgtagccgctctttcggcgagcgggtcacagactatgaggaaatgcgccaggctgtttacagctacgctgcgcgcgcggcagaaaaactccgcggcgagcaccagtactgctgtttcatttcaacattcgtcaaaacatcaccctttgccctgaacgagccctactacggtaacagcgccgcggtgacgcttctcacccccacgcaggattcacgtgacattatcaatgcggctgtgaaatgtctggataaaatctggcgcgacggccatcgctaccagaaagcgggggtgatgctgggtggcttcttcagccagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaacttgtgcgatcaatgcctgagatagttgctaaatcgtccccgttcttttggtcgcacaagatcacaggaacctctcacgataatgcgcatgtatcctggtttacgacatcaggaaatgtggcgcgtttattgccaggcaggcgttgtgagacgtaacttatttacgcctggtttcagccgtagcgatgggcatggataaaaagagtatggcaatcagcgtgataatgctaaaaaacaattaatatttttttaacaaaactaaagcttgctatgttcagttaaccatgcgttaatggttgtgcggtttgatacaaacttatctgaagtagtgattgtaatatttctcatcatttgttcctcttgagatctcctttaggtttttttctctctgataattttcttcaggccatttcgcccaagggctcattcaaaaggtaacaatattatgacgacgaaaatcactggtttagtaaaatggtttaaccctgaaaagggctttggtttcattacgcctaaagatggcagcaaagatgtgtttgtgcatttttccgccattcaaagtaatgaattccgcactctgaatgaaaatcaggaagtggagttttcagcagagcagggaccaaaaggtccatcagcggtcaacgttgtggcgctttaaggcaactgatattactaataaaattcacttccggtgtccatgttgccatggttcacaatacagaacatcgacattcgatgttactgagcaaaacccgtttggcgcgaaatgtattttttgtaagtcaaccatgatcacttttgataatgttggattatacattcgctcaggacaggttccgctagattttagaaaataattcatattagctccgtacaggagctttttttatgcccggatgattatcatctatagacgctgacatccatcatctatagtggcatttacctttccccaaaggtgttatttctcttgcagacagcgcctgaaaagagcgacgttgtcttcatctatccgatgaagcctggtcacctgtctttgcgccgttatccgttatttaattcttgccctataataacaagcccgcgctaagcacgggcttgaataacataaagcgtcttagaactggtagaccagaccaacacctacgatatcatcggttgcaataccgttgtttgcgtagaagtcatcatcttcgtccagcaggttgattttataatcaacgtaggtggacatatttttgttgaagtagtaagtcataccgacgtcaacatatttaaccagatctttgtcggtgtaacgccagttgccacgatggacttcctgaccgcctaaatctttgcccttagactgcaagtaggcgatggacggacgcagaccgaaatcgaactggtactgcgcaaccacttcaaagttctgggttttgttagcaatactgccattaccttcgccattgccgccgccataataggtcatgttgcgggtttcagcgtacatggccgccaggtaaacattgtaggcgtcatatttggcacctatggtccaggcttcagcggtttcaccgccggcatagttgttgcgctcattcatgccgtcgccataaccacgagcaacctgattgtccgaacggtcagaggaagagtaggccgcacccaggcttaacccgaagtcaaagtcgtaggaggtagacataccgaaaccgtcgccgttttcacgggccagtttgcggttgccgccgttacctgtaccttcaccagcaccagcaccgccgttttcattattaccctggtactgcaacgcgaagttcaggccttccaccagaccgaagaagtcggtattacggtaggtggcaacgccgttggttctgcccagcatatagacatcggtctgggtataagtatcaccgccgaattccggcagcgcatcggtccaggcttcaatgtcgtagataacaccatagttacggccataatcgaaagagccgtactcgccgaatttcagaccggcaaagcccagacgagtccaggagtttgcaccttcgccttcggtggtgttcaccttaatgttgtattcccactgaccatagccggtcagcatatcgttgatctgcgtttcgcctttaaagccaatacgggcgtaggactgatcgccatcgtcgcctgcattgtcagagaagtaacgcagaccatcaactttgccgtacaggtcgagtttgttgccatttttattataaatttcagccgcatttgctgcgcctgccactaataacgccgggacaagcagtgccagaacttttctgttcattatgtattcccttatgataataatttatatgaatatgtagccacttcaacaaaactacaaattgatactattctatgaagttcatggaatttaaaaaataacatgtaacaaagatatttaaaatatttcaatttgtttctatttggttttttataatacaggatatataagtgactaagaatatatagtctataattatcattttttatcaatgagttatgtgttttgatttgatggctgctggcgtgaatataatttgttttttatatgtatttgatgctttgattatgaaaaagcataaaaaaaaaccggcataaatgccggtaatgtgggtaatgataaaataaatgataaaaggctaataaccgaatcattctgacatttaatgctaataaaataaaacgctatcgcggtgcgtaaaaataagttgttctggttatgggttattctgcatcagagtgcgattcaattaccattcccttatttaacagcaggttcagcgccagacgcaacattaactgagaataaactatttgtggaatgaataaccagaacaggtggataaggtattccatggtcgaaatgtgactaatatcacattataatgtaattaatgtcatatgacttacatcacaaaagcggagtaaagtttgagtaccagggaggacaacgccacccgtagcatgggcggtaaattagcgttatgggttttttataccttttgcggctacttcatctgggcgatggcgcgttgcgtgtggctgatgtccgccatacaaaccgagccggttctcggcccaatcagcactcctggcagcgcaacggaaaaatggcttaacgcgctttcgctgggcgtcgtctggcttattctggggagtattgcctggtacacccggcctcgcaaaaacagggggtatcccgccgacactcagccagaaacgcgcaagcacgcaaggatgtaaagtggtggcggatatgtcaggatagcgaaccctgtgctcaggcatgtaataaaaatggtctgctataaagagagggcgtatggactcaggatactggcaatcgcagtttgaagactggctacgtcaccaccaccaggaacaggatgccgcccatgacatcttccattttcgtcgtgtttgggcaaccgcgcaaacgctcggggaaaacagtcctgtcgactggctggtggtgctatcggcatgttatttccatgacatcgtcagcctggcgaaaaatcatccgcagcggcatcgttcttccattctggcggcggcagaaacccggcgtatttttctgcgggattttcctgactttccggcagaaaaactggcgggcatttgtcatgctatcgaagcgcatagcttcagcgcaaaaattgcgcctaccacgccagaggcaaaaatcgtacaggatgcagacaggctggaggcgttgggcgccattggtctggcgcgggtcttcgcggtctccggcgcgctgggcgtcgcgctgtttgatgccgacgatccctttgccaacagacggcctcttaacgataagcaattcgcgctcgaccattttaaaaccaaactgctgaaactgccgctgacgatgcagaccgaacggggcaagcacctggcgcagcgtaatgcggattttctggtgtcgtacatggcgaaactgagcgctgagctgaaaggcgactatgaaacacgggatgatgcggtcatccagatgtttgctacgtatcagtaacccctgccgctgaaacgtaaaccgcgtcattttatgttagtctgtcggcaattatttttggccggttaaatgtatgcaggaaaatatttcagtaacacacgcccggaacctcatcgccgacgacgccggaagcgagatccaggcgatgctgagtcaattgctggaaatctacgatgttaaaacgctggtggcgcaccttaacggcctgggcgaacagcactggagcccggccatcttcaagcgcgtaatgatgaacgcggcatggcatcgtttgagcgacaatgaactcagctgtcttaaaacagagttgccgacgccgccagcgcatcatccacattacgcctttcgttttatcgatctcttcgcgggcatcggcggcattcgccgcggatttgaagcgataggcggacagtgcgtgtttaccagcgaatggaataagcacgcggtacggacatataaagcgaactatttttgcgatccgctgcaacatcgctttaatgaagatatccgcgatatcacattgagccaccgggaaggggtcagcgatgatgaggcggcggaacacattcgccagcatattccgcaacatgatgtcctgctggcgggctttccctgtcagccattttctctggcgggcgtttccaagaaaaatgcgctgggccgcgcccacggctttgcctgcgagactcaggggacgttattttttgatgtcgtaagaattatcgacgcccgccgccccgcgctgtttgtgctggaaaacgtgaaaaaccttaaaagtcacgaccagggcaacaccttccgcattattatgcaaacgctcgatgaactgggatatgacgtggcggatgccgctgacaatggcccggacgatccgaaaattatcgacgggcagcactttcttcctcagcatcgggaacgtattgtgttggtgggattccgtcgcgatttaaacctgaaaaccgattttacgttacgcaatatcgcccgttgttatccaccgcgccgtccgacgctggcagaactgctggagcccgtcgtcgaagccaaatatatcctgacgccggtgctgtggaaatatttatatcgctacgcgaaaaagcaccaggcgcggggaaacggttttggctatggcatggtttatcctgacaatccggaaagtgtggcgcgcacgttatctgctcgctactacaaagatggcgccgaaattctgatcgatcgtggttgggatatggcgaaaggcgaagtgaatttcgacgatgctggcaaccaacaacatcgtccccgccgactcacgccgagagagtgcgcgcgtttaatgggatttgaggcgccgcaaacgtaccagttcaggatacctgtctcggatacgcaggcctatcgccagtttggcaactccgtggtggtgccggtatttgccgcggtagcaaagctgctggaacccaaaattcaccaggcggtgacgctgcgtcagagagagacggcagatggcggacgttcacgataaagccacgcgcagtaaaaatatgcgcgcgatagcgacccgcgatacggcgattgaaaaacgccttgctggcctgttaagcgcgcaggggattacgtttcatactcaggacacgacattaccgggcaagccggactttgtggtgaatgactatgattgtgtgatttttactcacggctgcttttggcatcatcaccactgttatctattcaaagtaccggccacgcgaacggctttctggctggaaaaaatcggtaagaacgttgagcgcgatgagcgtgatattcagcgtttacaggcgcttggctggcgggtactgatcgtctgggagtgcgccttgcgcgggcgagcgaaattgagcgacgcggcgttggcggagcgcctggaagagtggatctgcggcggcggcgccagcgcgcagatcgacacccaggggattcatctactggcgtgaatcttccgttttacacggtgtgatcaccgccctggcgggaaacaggtacttacccagagtcactagcactacggcaaacacaatcacgcccagcgcggcccattcaacgggcgataacctctcaccgcctaggccagtgccaagcaacacggcgacaaccggattcacataggcgtagctggtcgccagcgccggactgacgttgcgaatcaggtacatataggcattaatggcgataatagaaccgaataacgccaggtagccgacggccataaaccccgataaaccaggcagcgtggcgagcttttcgccggaaagaaacgccgcgcaaagcaataccacgcccgccgccagcatttcaatcgcgcccgccatcatgcccacaggcagggcgatgcgcgagccgtaaacggaaccaaatgcccagctcatcgaacctatcaggatcaaaatcgcgccccacggattgccgcttaaattaccgccgctgttcagcagaataatcccggcaagtccaatggcaatccccacccattctaatttgcgcgttttaataccaaaaaagtagctaaagcacagcgtaaatagcgggacagtggcgaccacgacggcagcaatgcccgatggcacgttttgatgctccgccaccgtcaccagaccgttacccaccgccagcagcagtaggccaatcagcgcggcgttgatggtctggcgcagcggcggaagtttttcgccgcgcaacagcaaaaacgccatgagcaacatccccgccgagagaaaacgtacgcctgccatcattagcggcggccagctttcaacgcctatgcggataacaaaataggtagacccccaaatgatgtacaaggcaaaaagcgcgccaaaaagaggtaataactgccggaaacgcataatcactcacggtgaaataaaaagggtgaatatagtaaacgtcaaaattattatgctggcgagcattataattgtccttttggaataaaaaggcgttgacccgcgccgccggtttcggcattgcgcgttttgctacatacttaacgtcttagaagaaaagaccgaggaaatcattttggcaggaagtagcttactgacattactcgacgatatcgccacgctgctggacgatatttcggtaatgggcaaattggccgcgaaaaaaaccgcaggcgtactgggggacgacctgtcgctcaatgcgcagcaggtgaccggcgttcgcgctaatcgcgagctgccagtggtatggagcgtggcgaaaggatcattaatcaacaaggttattctggtgccgttggcgctgttgataagcgcatttatcccgtgagccattacgcctttattaatgttaggcggcgcgtttctctgctttgaaggggtagaaaaagtcctgcatacctttgaggcgcgaaaacacaaagaagacctggcggagcggcaaaaacgtcttgaggcgctggctacgcaagatcctttggcctttgaaaaagataaagtaaaaggggcggtccgtaccgatttcattctttccgctgaaattgtggcaattaccctggggattgtcgcgcaggcaccgctgcttaatcaggtgttggtgctggcggggattgcgttggttgtgaccattggcgtgtatggcctggtgggtattattgtcaaactggatgatatggggtactggctggcggaaaagcgtagcgtgctggcgcagggcgtcggtaaaggattactgattatcgcgccctggttaatgaaagcattatccattgtcggtacgctggcgatgtttctggttggcggcggaattgtcgtacacggtattgcgccgctacaccatgccattgaacattttgcgcagcagcagggggctttcatggcgcatacgatccctgcggggctgaatctggtgctcggctttattatcggcgccattgtggtggcgctggtgaaaggtgtggcgaaaattcgcggtgtttcgcactgattttctacaatgaattatgcaaaattgtccatcctcgtctaaggtgaaaacgtttcatctgatacaggaggcaggtatggtcttttctgtcagtgaggaagttaccgtgaaagagggtggaccccggatgatcgtcaccggttattccagcggaatggtagagtgtcgctggtatgatggttttggcgtaaagcgggaggcattccatgagaatgagctcgtgccaggcaaggaaaggcgcgtgcgggatgaagcccgatgacaaaacgcccggttaatgccgggcgttttgctgtggagaaaaagagtcgtcgcgctgcgacatgctgctacctggttatgccaggattgagtggtatcccttgatgaggtctggctaccgtaagccatcagggggcgttgtatcaataaccaggagttaccagggtgccgcacgaaacactgttagacaatcaaggctggtttaaaaagctggcgcggcgttttggtcccggtcatgtcgtcaacacctgttttctgatcgtgatgctgttctcgacgctacttacctggcgggaagttatgatactgaaagacgcgtatgtcgccagtcagcgcaatcatctggggagcgtcgcgaatgtccttgaccgccaactgcaattcaacatggacaggttgatctttttacgcaacggtatgcatgaagcgctggtggcgccgctggctttttccgcattgcaaagcgcggtgacgcagtttgagcaacgacgcgtcagacatttctggcaactggagttggataaacggcggacattgccgttatatggcgtttccgatcaatttgtcgcccggacgacgcttctttcgcgggagagtcgtgacctggcaaatgaattaaccgccacgctggagttagggtatctggcgcgctcatccgccatgctgacgctggagacgatgtatgtttctcgctcagggttttacctctcaactctccctacggcgtacggtagcgatattgtttcccgttactatcagtacgtgacccagccctggtttatcgagcaaagccaacggcgtaatccacagcgcggcgtgcggtggtttacctccgcacagccctatgttgctgacgagcagaaaaaagtgacagccagtctaccgctggatcacgataattactggtatggcgtactggcaatggatattcccgtcgcgtcattacagcagtttctgcgcgatgcggccgaaaaggatattgaaggggaatatcagctatacgataaccatctccgtttgttgacggactccgcgccggaacaacaaaccgagaatacgttaaatgaccgtgagcgcgccttactggcgcgtgaaatagaaaaagataccctgggcgggctgcgtttaggaacgcattatgtaagctgggagcggctggatcattttgatggcgtcctgctgcgcgtgcatacattacgtgaaggtatacaagggaattttggcagtattagtatcgcgctgacgctgttatgggggctttttacggcgatgctgttgatctcctggggcgttattcgacatatggtcaaaaatatgtttgttctgcaaaattcgccgcaatggcaggcatggcacgatccgctgacccggctatataaccgtggcgcgctgtttgaaaaagcgtccaggctggcaaagcgctatcgggaagcccgccagccattttctgtgatacagctggatttagattattttaaaagcgttaacgatcgctttggccatcaggcaggcgatcgcgtgttgtcccatgccgctgggctcattggcagcaccattcgagcgcacgacatcgccggacgggtagggggcgaagagttttgtatcgtgctgcccggcgcgacgaaagcgcaggcgctgcagattgccgaacgcatacgccagcgcattaatgacaaagagattctggtgacgaaaagcacgacgcttcgtatcagcgcgtcaatggggatcagtagcgcggaggaatacggcgactatgattttgagcagttgcagtcgctggccgacaaacggctttattacgccaaacagtccggacgtaaccgtatttgcgccagcgacgcgactcaggagcgggaaaagaaatagtccattccttcgcgccagccatccggcccttcgttctggctacggtagacgcgctgaggatcgtcgttacgcaaatgtacaccctcccggtttagccctttaacgacaaccgcataatccatcacatccagtaagggcgcatcattggggccgtctcctagccccaacgtcagaggacgcgcgcgccactgccgacgatatgcttcaattagccagttggcagcctgatctttaccggcggaggcgtccagcacatgccagaaacgggcgccatggacaaattgcagtcccaggtcatttaaacgggcgacaaactgcgccatgcgttcatcgctatcgcgccagatcagcgacaccgacgcttcatgcagacgggttagggcagactgtgcccggtttaggcccgtccattcgcttatcacctgatcgtcaacgtcatcaaacgtggtgaacttaaactgttccttttcacgcaacttatgcaggacgaggcggatttcgttgtgagaaataccggctatcaggcggggatagttgggatggtcttcccaatgaacgtccagttggatcaccgcgccgttttccgcaatcagcggcagtccctgtagatttaacgtcgtctggagctggagcatttcagccgcggttttactgctacagaggatcacaggcacgccgctttcatgcaggcgtgtaagccagggggccgcgggctgccactcaaaagtgtggctgttcagcaatgtgccgtccagatcggtaaaaatcagcaaggggtcatggattgagagcattttttcctcattttccgttgcaacggcgggcttatttccaggaaaaatcctaaagcacatccgaaagaagtcgaacgctaactggaaccgatcccgtcgcttccaggcagcacatgcgttgtcacacttttgctaccgaactattagcgcgcttaatcattcatgtaaaaaatatttacttgtcatgcaaaaaaattgcagataaagtaaatctcacatcagatttcctggtgtaacgaattttcaagtgcttcttgcataagcaagtttgatcccgacccgtagggccgggatttttttcggccatttttaacggtttacttctgttacactaaaatcatgaatatccagctcgaatgcttcagctaattcatgccatgtatgatattcccgtccgtctacgctcacccgctcaggatcttcctggctacggtgaacctcgctttcgctgatttcattgatggccgccagtagcgcatctacatcgacgctcacttcgcgcttggccgtatcactgtactcttttgccgttttcatcttcactacctcacgggttcctgacagcctaagtatagaccgttgagaaaaccagcaaacacgccggcaaggcgctgtcagacgcagaaaattgttctacactggcacaaagcgacaggaggaaaatgatgaaggtgaatgatcgggtaaccgttaaaacggacggcggtccccgccgaccgggcgtggtactggcagtggaagaatttagtgaaggcacaatgtacctggtttcgctggaggattacccgctcggcatctggttcttcaatgagtcaggtcaccaggatggtatttttgtcgagaaggcggagcaggactaattgagccggactggaggtacattgccagtccggatgtctcagcgcatgttagcaaaaatgccgttagtgacgttatctgtcagccgcactacgtgatagatcacttgtttattatgcgtttttatctttctttttatattccccttatgggaggatactgtttttgctttaatattcattctgtcagaaatctgaatggttccctgaccttccatccacattcgtaacatgctggattcagttcgacttaacgataatgttggtaaatttatggttcctgaaatacccgactcttttttcagaatatcgccaagaagggtatccagcgagtcaggtttaatcgatttagagctaatcaataagttttttcttactaataaatattcatcaaaatgcacattagcaattgccataaaaacaataaataacgtgtcaggatgctgattaatgatttgctttatttgttgactgtctgaaggcgtatgaatgaaacagtcctcattaataaacaccaccgaaggctgatgtgcgccacaagcgatagcgagttcgtcaacggtttcgatgtcgttgatttccctttttttcacccctctgctgaccagatacccgcttaaccctagccgggtgtaactgcataaatccataataatcgttgacatggcataccctcactcaatgcgtaacgataattccccttacctgaataactcaccataatcagacggaacacgaatagtcaccttagacaacgcttacgcggtttttcaggcgaacttactatcccgtaaagttacatataatttgccaggaatcatcttaaagtaaagtgaatgttgcgttatgtgagtgaagtaaaaacaaataaggggcagcggatatatcctggtgaatgttttttaaaatttattttcggataaaccttagtaaaacaggataaaaattatgggttattatttatcggcatctcgctaacaatatcagcaagcaaattgaaaatttcgctgaataaatgttcgcaaaacggcgcaattaatggcattagcgcggccatcagcataatgccgacggtgagggtaagcgggaaaccgataacaaatatcgagagctgcggcgccatgcggtttaatagccccagcgccaggttgagcgtaagcaggagggtaatgaccggcaatgccagcatcagtccgtttaagaaaatgagccctccggccctggcgagcgccataaatgcattactgttcaccgggttactaccgatgggcagagtatggaaggtatcgaccagcagcgaaataagccacaaatggccattaaaggtgagaaacagtagcatggcgagcatatccataatacgcgccagaaccggcatattcaagtggctgcccgggtcgacgaaggtggcaaaggaaagccccatttgcagaccgataaactcacctgcggtacgcaccgccgcaaaggcgaattgcatggtaaatcccagcgcaataccgatcagaatttgttgcatcgccagccataaggcggcaatagaaaaaagcggcgtatcgtttgctggtagcgacggcgcgataacgagggtaatcattattcccaaccccagttttacccgcttgggaatagcgcgctcgctgagaatgggcgccgttgaaatcagcgccagtacgcgcagcaaaggccagaaatagagatgcagccagtatagccattgctcgcttataacctgtatcatcgttctgtttatccgatgatataaggtaaattgctgaacagagtgcgtacgtagtccagcagcaggttgagcatccacgggccggcaacgataattgcgatgaataccgcgacgattttagggataaacgacagcgtcatttcattaatctgagtcgcggcctgcaagatgctgataatgaggccggtaatcagcgcgacgagtaacagcggcgcagccagggcgagagcaactttcatcgcctcggtccccatcatcatgacggattcaggagtcattttgcgcctctaactgtaaaagctttgggccagcgaccccacaagcaattgccaaccatcgaccagcacaaacagcatcagcttaaacggcagggcgattgtcgctggcggcaccatcatcatccctaacgccatcagtacgctggcgatcaccaggtcgataatcaaaaaagggatgaaaatcgtaaaaccgatctgaaacgccgtctttaattcgctggtgacataagcgggcaggaggatacgcatcggtactgcttccggtccctgtaacggaccgctattggccagacgggcaaacagcgccagatcggcttcgcgggtttggcgcagcatgaacgcgcgtaacggttgcgcgcctttatccagcgcttcctgcatagaaattttctgctcgctaaacggctggtaagcatccacgtaaatcttgtcaatgacgggcgacataataaaaaaggtcaaaaacaacgccagtccgagtaacacctgatttggcggtgccgagggcgtgcccagcgcgttacgcaacaagccaaaaacaatgatgatacgcgtgaagctcgtcatcatcagtaaaatcgccggcagaaacgtcagcgaggtgatgaaaaccagcgtctggacggataatgaccagctttggcctccgcccgctaatggttggctgataagccccggcagttgcgcagcggcggcgggactaaaaagccacagacccgccagagaaaggaataacaaacggcgcatcaggatctcccggaacgcttgagtaagctcttcatcatgttctggaaatccgccggtggggcaacgggtgcttccgtgtcattctccgcgggcgggagggtgtgcagcaggttgatctgcgaggcggtcacgcccagtaccaggcgcgcattttcgacctcgacaatcaccacgcgttcgcgcgggccaagcgaggcgctggctgacaccttcagtccccggacgctatttccttttggcgcgaatcccatacgcttaatcacccaggccgccgccagaatgagcgcaataatgccaattaatgcgccgctcacctgcatgagcggcgatccggctggcgcggtgggctgagaaaccgtggcctctgtcttcatcattaacgactcaaacgacgcatacgctcggatggcgtaataatatcggtgatacgtacgccgtatttatccgccacgacgaccacttcaccctgggcaatcaggtagccattaatcaggatgtccagcggctcgcccgccagcccgtccagcgcgacgaccgacccctgcgtcagacgcagcagttctttaatggtcattcgcgtgcggcccagctctacggtcagtttgaccgggatatccataatcagatcgatatcctgcatagcaccgctgacatcgccgccgccaagctgttggaaaaccgcgtcggcggcgcttttattggtggtcgcttttttctcgtttaacgcgtcagcccacagatcatccaatgcgccagtattctcatcggacggattattcatgtcactcatttgggctgttcctcattcagcgaattcaaaattgggttgatcaaatgttctacgcgtagcgcatactgtccgtttacggtgccatattggctggtgagtaccggaacgccgtccacatgagcaataatgcggtcgggtttttcaatcggcagtacatcgccgggtttcagcttcaaaatctgggaaagacgtaacggaatatcggcaaaattggccaccagctccagttcagagtgctgaacctggcgcaccaggttatcacgccagttctgatcttcatggcgcgagttttccagcggcggattcaccagcagctcacgcagcggctcgatcatgctaaatggcagacagatgttaaattcaccggtcagattgccgatctccacatgaaacggcgtattgacgacgatatcgttcggcgaggtggtgatattggtaaatttcacctgcatttcggaacgcacatactccacttccagcggattaatggctttccatgcgtcgctatagccttccagcgccagtttcagcatacggttgatgacccgctgttccgtatgggtaaactcgcggccctcgactttggtcggaaaacgaccgtcgccgccgaacaggttatcgacggtaataaacaccagactcggcgagaacaccaccagcccggtgccgcgtagcggcttcaggtggatcaggttcaggttggtcggtactggcaggttacgcgcaaattcgtgatacggctgaatacgtatggcgcccacggtaatatccgggctgcggcgcagcaggttaaataatcccatccggaactggcgtgcgaaacgctcgttaataatctccagcgcctgcaagcgttcacgcacgacgcgacgctgggtattgggatcgtaagggcgaatatcgctatcgcttgcgataccgggagtgggttcgtctttggtgtcgctgtcgccgttcaacagcgcatcgatttcagcctgagaaagaatactatcgcccatatcgttaccgcagaataaaagctgtataaagcacgtcagtgacgacctgttttggttgtccggcaacgagcggcgcggccagcgtctctttaatggcggcaatcagtttttgtttgccagcttctgttgagagctcggcggcattctgacgggaaaataacaacagcagacggctgcgcacttccggcagatattcatttaatcgtgcgcgcgtcgcttcgtctttcagacgcagggtcacgccgatatacaacacgcgatccgcatcgcccagattgacggtaaacgtatccagcacaaaaaataccggcgcgggcggcggagccggttccgctttagcgttcgtggtcggttgctgctgcatacgccagtagctataaccggcagtcgcgcaggcggcgagggtaatcaacaccagcaaaggtatccaaatcgagcgtttgctctttttgttaatcgcggagtcagtcatctgatacgggcttcctgtttcggtactgcttattggctgattatcccgtgtcctgtccacgacaaagcgtggaaaagacgcggataatcatgctacctctggcgttaggcgaagatatccactgcgccattgccgcgcgcggcggcctgaagcgaggccggcgccgctaacgctatatcatcttcagcgccaaacgcgtctgtgtgttgggcgcgggcagactgttgttgcgatgaagactgctgctgtccggcaaagctttcgctactgatactactttgtcccaactgaatgccgctttccgccaactgggtgcgtaacatgggcagggcggcttccagcgcggcgcggacatggctgtgcggcgataccatctggagctgcgcctgattgtcatccagcttgagcgaaatgtgcacctgacctaactcttccggatgcaatcgaagctgcgcgctttgctgtccctgacgcgtaaataacatgacctgctgactgaacgtttgttgccattcatggctgcctaacggcgcgctgagtaccggggctgaggcgacaggtagcggttgcggttgcgccgtggcgctgctgagcgtcggcattgccgcgccatgcgttactggcgcggacgggctatccacctccacctccactttcgcgctggtcgcggcggcagcgaccaccagcggcgtcagtgatggccccatggcgcgatcgtcgctggcgcgcgcaagcgacgcctcggttttccctttttcatgctcgctaaaagagagcgtatgtgtctcttcctgcggcgccgatagcatgtcgccgcgtaacagtgacggcaaggcgatgtgattttcagccggcgtttctccggcgacaggcgtcgcgacaggttgtccgggcagcatggcgaataaggcgctcagactggcaagatcctcatcgctcagcgcgggcgttttctcatcatgctgcgccgttttactcaatgcggccagagcgctggttttcaacgatggcgttagcgtagacagtagatgctgcgcttgtgtcagattggtaagcgtttcatccgtcgcattcgctttttgcgccagcaggtcggcaagcttcaccgcctggcccggctcgccatgttgggccagtagctctttcgataacttgccgcctgccgcctgtaaatcggccagcgtgatgcgggcgtctttgccctgtgcgccgtctgcgcctaacgcgcccgccaggagcgccagaaagtcctcggctgaaccggtggtttttcctgacgtcagacccgcggtcatgtcggtatcggtggtgatcagttggggcagggtgatcattcgggtttcctcattgctgcacgctgagcaaattcatccatctttttctgatccatgcggttttcagctaacagcgctgccgcggtttgtcggtcctgtaaggtttgccaggcctgaagtcgctgctttttctcacgccagctcttcagcgccaggtcgactttttgcgtccactgcgtaagctggaggcgatgctgctctatcgccttttccagtgtctgaataaactgctgatagttgatccagcgattactggcgatgccgttgcccatatcggtgttcaaattactgcgatactcattctgataatcgatcagcattttgagctgttcttccgcctgttggcagccgcgacgcatttcgcccagtaaacgcgccgcgtcatctacctctttttcggccagatctttgagtgtttccagagcgccatgttgtgccatgatcgtcgccctcctgatttatcacaccgtcgggaaaattaaatcgagcgcctgaagagagtcctcccagtcggcccgttcaaaaatgccttgctgtaaaaacgcttctaattgcggccataaggtaatggctttatcgagcatcggatcgctgcctttggcataggcgccgacgctgatcagatcgcggttacgctggaaactggaaagcaattgtttaaatagccgtacccgcgcatagtgctgctcggtaatgagcgcggtcatcgcccggctgattgacgcctcgatatcaatggccgggtagtgcccggcttccgccaggcggcgggacaagacaatgtgcccgtcgaggattgcgcgtgccgagtcggcaatgggatcttgttggtcgtccccctcggtcaatacggtataaaacgcggtgatagagccgccgccgtggatgccattaccggcacgctcgaccagcgctggcagctttgcgaacaccgagggcggataacctttggtggctggcggttcgccgattgccagggcaatttcacgctgcgccatcgcatagcgcgtcagcgaatccataatcagcaacacatgctgtccgcgatcgcgaaagtcttcggcgatgcgggtggcataggcggcgccctgcattcgcagcagcggcgaaacatccgccggggcggcgatcaccaccgaacgcgcgcgaccgtcggggccgagaatattttcgataaaatctttaacttcgcggccacgttcgccgataagacccacgacaatcacgtccgcccgtgtgtagcgcgccatcatgccaagcagaaccgatttaccgacgccggaaccggcaaagagtcccatacgctgaccgcgccctacggttaacaacgcgttgatggcgcgtacgccggtttccagcacatgttcgattggcgttcgctgtagcgggttaaacggcggcgtgattaacgcgccggtttccagcgtatccggcgcaggcagtccgtcgagcggtttaccgccgccatccagcacccgaccaagcagggccgggccgagcggtaactgtttgccgctttgcagaccgtcgccatgcccgttacgggcgtaaacgcgggcaccgggcagaatgccttcgacctcttccagcggcattaaaaacagacgctggccgttaaaaccgacgacttccgattccacctctttggtttcagggccgtcctggcgctcaataatgcaggtggcgcccagcggaagctggagaccggtggcctccagtaccaggccagtggcgcgggttaaacgtccataacggcgcaccgccggcaataacgccatttttgcttcaaagttgtcgagcgcggtaagccagcgggtcaggcgcgtggtcatcagagcactcccggcgccgccaggcgacacaactcttgccagcgagtggcgacgctggcgtccagatcgccctcatcggcagagactttacacccgccgtgatgcaacgttggatcgccgcgcaaccgccatccgtgaagactgagcgtggcgcccagcatctcttccacccgctgtaagtcgtccggatgcacgcgcaactgcggcttgccgctaaagagcggctcttgctgcaacagttgttggatctgtttaatcagcgctgagttgtccaccgccggcgtttggccgatgacctgacgtgcggcctccagggccatttgcatcagccgtgaggcgataacgctatcgagcgcgtcaagcgtgttctgaaactcgctcactaactgctgcatacgggcatgaatcggcgcctgctgcgtctgcgcctgggcttgtccttgctccagcccttgcgctaacccttcctggtatccctgcgcgtgtcctttttgccgtccctccgccagcccggcgttataaccttgttcatgggcctgtatttttagctgcgccagctcctgctccagctgctgttcggcagtgagttcgggctccggcgtatcgtctgtcaaggtaacgttatcagcctcaaccggcacaaacgtctccggcggcggagcgagatcgtcgggggtccagacttgccacggcaattcattagacataggtatcctcgccgctgccaatcaccatttcgccggtttccgccagacgacgcacaataagcagaatcgctttctgctcgttttccacctgagacagacgaaccgggccacggttggcaaggtcgtcgcgcaggatatcggcggcgcgctgggacatattgcgcaggaacttctcgcgtaatggcggttcggcgcctttcagagcgatcagcagcgactcggaatccacttcctgcagcagacgttggatactgcgatcgtccacatccaccagattttcgaacaggaacatctcgtcgatgattttctgcgccagttcgccgtcgaattcgcgcacagcggtaataaccgcttcttcctgctgcgttttcatcaggttgataatttctgccgcggttcttacgccgcccattttgctgcgtttcaggttctgaccgtcgagcaggccattcagcacttcggtcaactccgccagcgccgccggctgtacgccgccaaatgtcgcgatacgcagcatcacatcatgacgcagtcgttcgtcaaacagtgccagaatatcggcggcctgactgcgtttgaggtggaccagaatggtggcgataatctgcgggtgttcgtcgcgaatcaggtcggcggcgctctgcggttccataaagttgagcgtttcgataccgctggtggtatcgcgcgtttccagaatatcttccagcaggctggaggcgcgttcttcgcccagcgctttaaccagtacggagcgcaggtattcgttggcgttgatattcagcgcggcgaactgctccgcttcttgctcaaactctgatagtacgtccgtcagttgtttgttggagatctgacgcacgttagccatcgccgtacttaacgcctgtacttcgcgggtggagaggtgtttaaacacctctgccgcccggtcttcgccaatggtcatcaacaaaatgacgcttttatcggtaccgctaagattactcatgatcgttactcatccactggcgaatgaccagcgccaccacgcgcggatcgttgtctgacatttcgcgaatacgctggctcatcacctcagcgcccagacgctggttagcccggcgttgctggagctgctcgtctttgctaaggcgtacttccacggcttcttcggtttcctggcgaacctgcgcctgttcctgcgccgctttcgcttcttcaacgcggcgcgtcaactgtggatgtaccgctttgcgccacagaatccaggccaccaccagcaccagtaaccagcgacctgccgcgagcaactgatcgataaaggactgctgttgccagaagggcagttcgccgccggtgttatccactgcgctaaacggtgaattcaccacgtttagcgtatcgccgcgtttatcagaaaaacccatcgcttcacgggttaaatcctcgatctgtttcatctgatcggcggtcaatggcagcggtttgccatccgccagcgttttgtaattcaccacgacagctacagagagacgctcaatatcgcccacattcattttggtgtgacgaatggtgcggtccacttcgtagttactggtttcattacgctgcgtattgcgcgggccagcgttgttactgttggtactggtgctggtttgtggcgtattctgcgcgttttgttgattggtcggcggtgtggcgatcggcgcctcgttaggcggcgctggttggttcgacagcgcgccaggcacgccgccgggatagcccgcgcctacctgttcgctaatattcaactgacgtgaacgcagagtggccttcgacgcatcgccgttcgggctgtagtgctcttccgtctgttctttattggcaaaatccaactgggcggttacctgagcgtgaacattaccgttcccgacgataggcgacagaatggcttcgatacggcgttggatgcggctttccacatcattagcaaattttaattgcgcgtcattaaggtcgcgaccgctggtattggattgcgtgagcagatgaccggattgatcgaccagagtgacgtttcctggcggcaaaccggcgacagcgctggaaaccagatgtaccacggcgctaatttgtccttcatccagcgcccggcccggttccagtgtgacggtgacggaggcggaaggggatttttgttcccgcacaaatagcgacggctttggcatcgccaggtgaacgcgggcgctttttaccggacccagcgtctcgatcgtccgggccagttcaccttccagcgcgcgctgataattcacctgctcgctgaactgactgataccgaatttttcctgatcaagcagttcaaagcctaccgcgccgcctttaggcagcccctgctgcgccagacgcagacgcagttcatgcactttgtcggcgggcacttcaatcgcgccgctgccattggcaaagcgataggggatattcatctgggtcaactgcgcgacgatcgcgccgccgtcctgatcggaaaggttgctaaatagcgtgcggtaatcgggcgttttggcccacagcaccatcgcaacgacgatcgccacggcggcggaacccgccacaattaacggaattcggggattcgcgcgtaggcgattaagccactcgagaggtttaggttgggttgcagtcgatgcagtcgcactcatctcgcacctcgtgactgatcgtggacggcgttttttgcaaagtggaacaagactcactcccgggtcagcaaactcgaaaaattgacggtctcattatttgtggtttcgaatttttctatgcgctaaaaaccgaggttttttatcgttatttaacgcctttatcttattgacaaactggtaatctctgctgcgtaaaaaatcatccaggggaataacatggcagcaatacaggggattgaagggggtattagccagttacaggcgacggcgatggccgcaaacgggcaagaaacacactcgcagtcgacggtgagttttgccggccagctacatgctgcgctggatcgtattagcgacagacaaacggcggcgcgcgttcaggcggaaaaattcactctgggtgagccgggcattgcgcttaatgacgtgatggctgatatgcaaaaagcgtccgtctctatgcaaatggggattcaggtgcgcaataagctggtcgccgcgtatcaggaagtcatgtccatgcaggtttaagccagggctgacaacacatccgcagcgaactcccgggcgcttacctaagtcagtggcgggggacgcgacgcccatgcaaccagtgcgtgattatgtgggcttgtttttgcgaggcgcgctcattttattgataagcgggttgcacattgttgcagggacttattaaaaatagggtacgcctgtttactgacgccattcattcctactattagttctgaggctattgtcattgagtttgcaatccagaatgttcctgcaatatatgcgccgttgcgataatacacggtaaattctttactaatacctggaatatctgtttcatggagatccagtatatacccatacggggacagattatcagcgagacagcgggcaatggcgctcggatgtgcattgactactgtgacgggtgagtaacgggcagcggcaagacagacgactccaataatggagatgaaaataatttttatcatttttttggcttctgctgtgcataaataaatcatcacctgataatgtcagtgagtaaaaatataaatacctgatagtcttttatgacgtagagggaaaataataattattttatgttttgcttaaaatagtcatggttttttcatcggctcagacaaaattaaaacggtatacgttatataatagatttatgccacggcgcacaagacgaccttgtctgatttcttttatgcgttttagatttttgccggttatgccgtaaaaggtctcccgccgtaacgtacagcgggagtatgcgcttatttttgaatcagataacgaattgtcgggccatcctgctgaatatccagcaccgtataaccgtgattgcgcgcatccagtggaatattattaatggactgcggacagtcgctgaccacttccaggatctcacctttttttagctgcggcatcgcttccagagtggcgaccgccgggtacgggcaaggttcgccaaccatatccagacggtaatcagggacgatatttttcatacagattccttagcaggcgtcagccccgcacggcggaaaaaacgtttttcccagccgatgattaacatcagcgcggtaaataacaacagataggtgaccagcagaccccccagcggaccaaaggtattcagcaggttaactttatcccaactggtcgccagcgcgggcgcgaaatcatcccagtagtaagccaggatggtcgaaccgatgacattgccgaggcccacccaccagtaatgcacctggacttctacggcgcggtacatccagccggtttcgcagccgcccgccagcacgatgccaaaaccgaacagcagtccgccaatgaccgcattcgggccagcccacataattttaggtgcaacgcccaactgcacgtagctgaaaataccaatggcgctgaccgccatgccaaaaataatcgctttcgccatatgggcgcgtccggagatccacagatcgcgaaaggccgaggtaaagcagatttgcgcgcgctcgatcagcagcccaaacccgacgccgaacagcatcgccagccccagtttcggctgatgcattgccgttaataacgcccagccaatcatgccgataaagaccagcataccgagcctgaaacgccgtcttgcctgatccggtttctgcgtcagtggcgaagccgcggagaccttttgcattttcaccggtatgcgaaatatcggcagcaacgtaaagcgggcgccgaaccaggaaccgatagcggtcgccagcgcaaagaaccacgcgtgtagggagaactgcgggatcccggtaaaaaaggcggccaggttacaccccatcgccagacgcgcgccgaagccagcgatcatgcctccgaccaccgcctgtacgatacggattcggctgcgcggcatacgcagttttacgttgttggcccacagcgccgcggcgaaacagccgccgaacatgccgaggatcatcatgccgtcgatacgcgtcagcggcgtaccttccagatgaatcagcttgtagtagccccactgttcggcatgaacgccaaaaagctgcaaaatttgcccgccccagcgggtaaattcgcccgtcacggcccaaaacgtgccggtgatgccaaaatagtaggtagagagaataccggctgcgatcaccgcaggggccggcgcccagaatttaattaaccaggtttgcttgaagtgttgccatgacatgtgtttagcctctgaactcagaaggtgtgaaacaagaagtgcgcatactacaccgatcacagaatttgcctacacctaataagcggtaataccgactggatcaaattgcggccagcgcctggaaaggctggcggcgtcagggctttaatgccacaattcttctttcttctttcttctttcttctttcttctttcttctttcttctttcttctttcttctttcttctttcttctgatgcaggatgaatgatgaaaaaagtagcgatcgttggcgcattgctggttctggccggatgcgccgaggtggaaaactataatgatgtggtgaaaacgcccgcgccggccggtctggaagggtactggcagtcaaaaggcccgcaacgtaagctggtgagccctgaagctatcgccagcctggtggtgactaaagaaggcgatacgctggactgccgccagtggcagcgcgttattgctctgccgggcaagctgaccatgctctccgatgacttaaccaatgttacggttaagcgtgagctctatgagattgagcgcgacgggaataccctggaatatgatggcatgacgctgcaacgggtcgctcgtccgacgccggagtgcgccgccgcgttagaaaaaacgccgctgccgacgccgctgccgtaatttcgcttcccggcagcgctctgccgccgggaacgctcatcacacgtcctcaatgacccacacgctgacgctgcctgcgttgcagaagaacgtcgcttcgccttgatcattagttacaacatgctcactgcggtttcccagaaaatcacgccaggtcttgttagcgtaattgtcgccgagcaggagggttttttcaccgtcgtcgccattggaaagtacgaccacacagcctggattctcttcagtaccgctgcgactaaaggcgatacagttgggatgatcgaaaaagagtgtttgtataccgtgcgcaaaacgctgacgagcgaggatcagccgatccagttggttaatcaccggcatgtcgacccgacaggtctcgccattttcgccgttatcctcatagctggcgccgtataaatcgggataaaacaccgacggtacgccgttttcacgaagcaggatcagcgcataggccaatggtttgaaccagggttctaccggcgcttccagcgcctgtaacagttgtgtatcgtggttagcgaccagcgtcaccgcatgaaaagggtcggcttctaccagcgtgccggtgaaaatgtggcgcatgtcatactccgcgccctggcgcgaggcttcatgaaatttcatctgcaacggcgcgtcgaacagcatggttttcccgtcggcctgatcgatgtacgtttgcagtttatccacttcatgcgaccagtattctgcgacaataaacagcggttttggcgcaaccgcctgtacatgctcaatccattctttataaaaccaggcgggtatatgttttaccgcgtccaggcgaaagccgtcacaatgggtttgttccatgacccaacgagcccaatatttaatctcttccgtaaccgcgtgattgcgaaaatcgatattttcccccatcagatagtcgaaattacccagctcatcatcaacctgatcgttccagccatcgccggtatagtcattgacgatcttaaaaatgccgtcttcgtcgggattctcgatgtgatcaatgccgctgaaacagtgatagtcccaaataaagttggaatactggcccgcgcgggcagggaaggtgtagcgcgtccagccttcgcattcaatgatgttgtcatcaatttgcgtgcggtcatcctgattcacgcgctgaacgcgaatacgttctttttcgtctgcgcccattttgtggttcacgacgacgtcgagcagcaccgcaatattattttttttgagcgcgtctatcgccgtcagtaactggcgtttatcgccgtactttgtcgcgatagttcctttttggtcaaattcgccgaggtcaaacaggtcgtagctatcatagcctacggaatagccgccggaggcgcctttacaggcgggcggtagccagaccatattgataccgatatcattcagcccatcagcacgttccgccagctcagaccagagttttcctccgtcgggataataccagtggaagtactgcaataacgtggggtttttcatcttccgtgctccagaagtcgtttagccgacctctggagtatggaagaattttcatacgagacgggaaaatattatgaggcgccaggtgcgtctggcacgagtaacataccggaaagacggccataagcgttgttgagtgatttttggcgggtggattgtccgatcaaactactcagttcatccagtcgctgttgcagcagccctttcaggagctgctcattatccagcgtttgtttgatgtatccggcgaccatatcctgaatacttcgcgtaatgcccggtggagtttgcttttccatcaccgtttcaatactttgcagataggagacctcttgttgcagtaagagatcccattcacctcgctgcgcaagttcaagcagcgattgactgagcagcgcaatacgctgccaacggttgataaactccacggttgaggtcattaacgagactcctggaaagatgctttcggtgaaatctgcttccaggcttctgcaatattgctgagtaacctttccacttcttcgatggcctgagcgtcgttacgcaaattagcctgcagtaaacggcgaatcatatagtcgtatagctcggaaagattcgtcgcaatctcaccgcctttttcctgatcgaggccggctttcagcccgttatcgataatattgatggctttgcttaacgcttcacctttcgcgacaacatcgccttgttctaaaaacaggcgagcgcgcaccagagcgctattcgcgccatcaaacaacatttcaatcaactgatgcgggctggcgctcatcacggcgctttccacgctgacttgcgcataagctttgataccgctcgcggtgtacatggtgacctctgttatcaggacttgttcatagctgtaaattgctgggtcaaataactactggtgttattcagcttactcatcatggtatccagttgggtaaactgggccttgtaacgggcaacggtttcatcgatgctgttgctaacggacaggtactgttttgtcaggcttttcagcgtggcgttaacgttgtcctgcgcattatcaataatgccgtcatccgccagataacttttcacttcggtggcaattttggtggtgatacccgtttctttaccatcgcctaccagcagctcacgcgctgcggccgtgttatctttcagtaccttggtcagcttatcatcgtcaatcttcagtttgccggaagtcccatcctgggtgatgccaatttccgccattgttttgaacgcagaattactgccgctattggcaaattgtgcccgaatcccggtctggatagcacgaaccacactatcgcctaacagcgcgccgtttttatcgctggcttcttcgcccggctcaacggcggtatatttagttaatgagctaaaagtatccaccagcgagttataggcatccacccaggatttaatcgcctctttcgccttggtatcatctttcgtcaccgtcacggtcgcgtcggtcactttcttggtcagggtgagtgtaattccctgaggggcgtcggttacggtattgctctgacgctcaatgtcgatgccgtttacgttcagcttcgcgttttctgctttcaccagctcttgcatattgccggtattggtggtgctgtcataagcgagtagatcgttaagttttgtatcgccttccaccgtgatcttcatcgtattgtcggtaccgctattggcggtaagcaccaactggaattcgttctctttgaccttaacgatactggcggcgataccgctgtcggcgtcattaatggcgtcacggatcgcctccatggaggtgtcgcctttatccagcttaatttccagcggctctttacgtcccggctgttcaattttaattgtccgggatgtgaccgacgtatcgcccaactgctctttggtggttgcgaaggtggtttttgtcgccagcgactgcgcggcggcaagctgggttacgctaatcttataagtccctgcggcagcgcctgcggtagtactgactttgaggtcctctgtcgtgctggacgccacggtagacttaaataaatccgctttatttaacgcggtatttgccgtctggaatttttctaatgcgcttttcaatgtgccataggcggttagctttgccgaattcgcgctctgctgtttggtaattggcgttaagcgtcctttttcgttctttgtcaggtctgtcaacaactggtctaacggtaagtttgatcccacacctaatgatgaaattgaagccatgccttcttcctttttgattgcaaacagtagttaagcgcgttatcggcaatctggaggcaaagtttaatgataattttgcaaaaataatgcgcggaataatgatgcataaagcggctatttcgccgcctaagaaaaagatcgggggaagtgaaaaattttctaaagttcgaaattcaggtgccgatacaagggttacggtgagaaaccgtgggcaacagcccaataacatcaagttgtaattgataaggaaaagatcatggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgttaatccggcgattgattcaccgacacgtggtacacaatcaaggcagcgaaagctgccttttttaattccggagcctgtgtaatgaaagaaatcaccgtcactgaacctgcctttgtcacccgcttttcctgttctggctcggcctgtcgcgaccattgttgtaagggctggaaaatcacgctggataagacgacggttaaaaagtatctcgccagtaaagacacgacgattcgtaccatcgcgcaagaccatattattctgctgaaaaagaacaataatcattggggggaaattaaactgccttcggcgctgggaagttgcccttatctggatgaggaccgtttgtgccgggtacaaaaacgttaggcgcaaaggcattaagtcatacctgttcctctttcccacgggcgcaccatacctataaaaatgaggtacgtaactccctgagtcttgcctgtccggaggtaacgtcccgcattttaaacgatcctgacgcaatggcgctcggcgaaaaaacaatcattcagcagacattcaatactgcgccgttattctcaccgcagcaaaagttactcaatctgttttgcctgagtctgatcaaccatgccaacagcagtacggaaacggcgctctatgggttgattaaattcgtcatgtatgcacataaatttgccaaaattgatgatgccgcgctgggtgaactggaacaggtgtatgccgcgttacttgagcagttgcagaccggcgtgctggcgcaggaattgatgaatatcgcgccggacagcaaggtaaaaacctcgctggtattgcagatgcagaactatttccgctcgctcccgcttagtcgtggcagtgttatcctcgatcactatatccagtgtcttctgcgggtgctgacggcggaagagggcgtttcaatggagcagaaggttagcgatattgagtcctcattagcgcgctgtttacaggcggatgagcagcagaagaactgggctttcagaaatttaattctctataaaatttgggaaaataatttccccaaccagccgaatgtcgacccgttacgcgcgctgtatattatcgtggcggaatatgcctttattaagctattaacggcagccagcgtgcatgagcgcgggcggcttgagtgggatgacgttaccaatattgtgtatagctttcactcccgcagccagcataacagcgaggtggcggcgaattttcatcgccatatagaaacggtgcgtactggcgacgatctgtcgatgattcatcttctgacatagttttgttcggggtgggcttttgcgcatcccgtttatcctatctggctgattttattctgctctttgaaccgctaaaaaggcgctacaggttacataagtgaaataacccttcttttatagccttattccttcgatagaaccctctgtagaaacggataatcatgccgataactcatttaacgcagggctgtttatcgtgaattcactgtataccgctgaaggtgtaatggataaacactcgctgtggcagcgttatgtaccgctggtgcgtcacgaagcattgcgcctgcaggtgcgattgccggcgagcgtggaactggacgatctgctacaagcgggcggcatcgggttattaaatgcggtcgaccgatatgacgctttgcaaggaacggcatttaccacttacgcagtgcagcgtattcgtggggcgatgctggatgaattacgcagccgcgattgggtgccgcgtagcgtccggcgtaatgcccgcgaagtggcgcaggcgatgggacaactggagcaggaactggggcgtaatgcgacggaaaccgaagtggcggaacgtcttggcatccctgttgcggagtatcgtcagatgttgctcgataccaacaacagccaacttttctcttacgatgagtggcgggaagagcatggcgatagcatcgaactggtgactgaagaacatcaacaggaaaacccgttacatcaactgctggagggcgacctgcgacagcgggtaatggatgcgattgaatcgctgccggaacgcgagcaactggtgttaacgctgtattaccaggaagagctcaatctcaaagagattggcgcggtactggaagtcggcgaatcgcgggtcagccagttgcatagtcaggccatcaaacgattacgcaccaaactgggtaagttataggtagcgcatgatcgcacccgaaaagtgccgcacaacatatagactaccaggagttctcatgacggtgcagcaacctaaaaggcggcccttgagccgctatcttaaagactttaaacacagccagacgcattgcgcgcattgtcacaaattgctcgaccgcattacgctggttcgccgtggcaagatcgttaataaaatcgctatttcacagctggatatgctacttgacgacgctgcctggcagcgggagcagaaggagtgggtggcgttgtgtcgcttttgcggcgatttgcactgcaaaaagcagagtgattttttcgatattatcggtttcaagcagtatttgtttgaacaaaccgagatgagccatggcacggtgcgggaatatgtcgtgcgtttacgacgtcttggcaattacctcagcgagcaaaacatttcccacgatctgctgcaggacggttttctcgatgaaagcctggcgccatggttgccggaaaccagcaccaataattaccgtatcgcactgcgtaaataccagcaatataaagcgcatcagcagattgcgcccagacagaaatccccctttaccgccagttctgatatatattaaaaaagcataagatgtagcagagtcgtgttggtgaaacgtggcaaaccttctacattaggctgagtcccccaaaggttcgcgagacgtgacgatgcgccatggcgggacacagtctatggtcattaacggcaatattcggggttactatgaaattagcactgctgggacgtcaggcactgatgggagtaatggctgtagcgctggtggcgggaatgagcgcgaagagctttgccgatgagggtttgctgaacaaagttaaagaacgcggcacgctgctggtagggctggaaggtacctatccgccgtttagctttcagggcgacgacggcaaattaaccggttttgaagtcgatttcgccgaggcgttggcaaaacatctgggcgttaaagcgtcgttgaagccgaccaaatgggacggaatgctggcgtcgctggactctaaacgcattgatgtagtgataaaccaggtcacgatttcagacgtccgcaagaaaaaatatgatttctctacgccttatactgtctccggcgttcaggcgctggtgaaaaaaggcaatgaaggcacgatcaaaacggcggccgatctgcagggcaaaaaagtcggcgttgggctggggactaactatgaagagtggctacgtcaacatgttcagggcgtggatatccgcacctatgacgatgatcctacaaaatatcaggatctgcgcgtaggccgtattgacgcgattttagtcgatcgtctggcggcgttggatctggtgaaaaaaaccaaaggtacgctggccgtcaccggtgatgcgttttcgcgtcaggagtccggcgttgcgttacgtaaaggcaacgaagatttgctgaaggcggtagataatgccattgcggaaatgcaaaaagatggcaccttaaaagcgctctccgaaaaatggtttggcgctgacgtgacccaataatgctctacgttgcccggcaggtagtgcgccgccgggcaatatcaacctcatactatgtcagcaaacggaggcgcgtgaatcggcgccttttttatttccattagatcaacgtgcataataaaaagaacacaccacaacgttaccggaggctcaatgccactacatcacttaacgcgctttcctcgcctggagcttattggcgcgccgaccccgctcgaatacctgccgcgattgtctgattatcttggccgtgagatttacattaagcgcgatgacgttacgcccattgcaatgggcggcaataaactgcgtaagctggagtttctagtggccgacgcgctgcgagaaggggcggatacgctgataaccgcaggggcgattcagtcaaaccatgtccgtcagacggcggcggttgcggccaaattggggctgcattgcgtcgccttgctggaaaatccaatcggtaccaccgcggaaaattacctgacgaatggtaatcgcctgttactggatttatttaatacacaaattgagatgtgcgatgcgctaaccgatccggatgcgcagctgcaaacgctggcgacgcgcattgaagcgcaagggttcaggccctatgtgattccggtcggcggctccagcgcgttgggcgcaatgggatacgtagagagcgccctggagatcgtccagcagtgtgaagaggtcgtcgggctctcttcggtggtggtggcctccggcagcgccggaacgcacgccgggttagctgtcgggctggaacatctgatgccggatgtcgaactgattggcgtgaccgtttcacgttctgtcgccgagcagaaacccaaagtgattgccttgcagcaggctattgccggccagctggcgctgacggcgacggcggatattcatttatgggatgactattttgccccgggttacggcgtgccaaatgacgcggggatggaggcggtgaaactgctggcgaacctggagggggtgctgctggatccggtatataccggtaaagcgatggcgggtctgatagatggcatcagccagaaacgctttaacgatgacgggccgattctctttattcataccggtggggcgcctgcgctgtttgcctaccatcctcatgtataacctccaggtaatcaacgcgaatgcaagaaagtatccaactggttattgaatcgctgccgtatttgcttaaaggcgccgtctttaccctgcaactgagtattggcggtatgttttttggtctgctgctgggatttgtgctggcgctgatgcggatgtctccgctatggccggttcgctggctggcgcgcttttatatctcgatttttcgcggtacgccgcttatcgcccagttatttatgatctattacggcctgccgcaatttggtattgagctggaccctatcccggcggcgatgattggtttatcgctcaataccgcggcttacacgtccgagacgctgcgcgcggcgatctcggctatcgacaagggacaatgggaagcggcggcgagcattggcatgacgccgtggcaaacgctacgccgcgctattttgccgcaggcggcccgcgtcgcgcttccgccgttgagcaacagctttatcagcctggtgaaagatacatcgctcgccgcgacgattcaggtgccggagttgttccgccaggcgcagttaattacctcgcgaacgctggaggtgtttaccatgtatctggccgcgtcgttaatctactgggtaatggcgaccgtcttatcggcactgcaaaactatttcgaaaaccagcttaaccgccaggagagagagccaaaatgagtgctatcgaagtcaccaacctggtcaaaaaatttcatggtcaaacggtgctgcacggtatcgaccttgaggtgaagcccggagaagtcgtcgccattatcggcccgagcggctcagggaagacaacgttattacgctgtattaacctgctggaacaaccggaagcgggcaccattaaagtaggcgatattatcatcgataccgcccgcccattcagccagcaaaaagggttgattcgccagctacgtcagcatgtcggctttgtctttcagagttttaacctgttcccgcatcgtaccgtgctggaaaatatcattgaaggtccggtgattgtaaagggagagccgaaagctgaggcgacggcgctggcgcgggaactgttagccaaagtcgggttggccggtaaagagacccgttatccgcgccgcctgtcgggcgggcaacagcagcgcgtggcgattgcgcgcgcgctggcgatgcgcccggaagtgattctgtttgatgagccgacgtctgcgcttgatcctgaattagtcggcgaggtgcttaatacgattcgccagctggcgcaggaaaagcgcacgatggtgatcgtcactcacgaaatgggctttgcgcgtgacgtggctgaccgggcaatatttatggatcaggggcaaatcgtcgaacaggggccggcgaaaaccttgttcgccgatcctcagcatccgcgtactcgccagttccttgagaaatttttagtgaaataataccttttcaacgctcgcccgaattagccgtgcctcgggcgagcgcaatgaataattatgaagtcattctgccagattattaacctcgctctttggcggaagtcgaaaaactgtaatgccgctcaagtattctatgattcgtccgatattccttatatataaacaccatttatgtgttaatttaagtcattcataataatgattatcaatatcaaaggcgtgaccataaaatatgcaggaaaatgatttcttcacctggcgacgcgcaatgttgttacgctttcaggagatggcggcagcagaggatgtttatactgaattgcaatatcagacacagcggctggaatttgattattatgccctgtgtgttcgtcatcccgttccctttacccggcctaaaatatcgcttcgtaccacttatcctcaggcgtgggtaacgcattatcagtccgaaaactatttcgcgattgatccggtattaaagccggaaaatttcaggcagggtcatttacattgggatgacgtgctatttcatgaagcgcaggcgatgtgggatgccgcccagcgtttcggattacgcagaggcgtaacccagtgtgtgatgttgccgaaccgggcgctgggctttttatctttctcccgtagcagtttacgctgctcctcgtttacctacgatgaagtggagctgaggttgcaactgctggcgcgggagagtctttcggcgctgacaagacttgaagacgacatggtgatggcgcctgagatgcgtttcagtaaacgtgagaaagagattctgaagtggacggcggaagggaagacctcatcggagatcgccattattctgtcgatttctgaaaataccgttaacttccatcagaaaaacatgcagaagaaattcaatgcgccaaataaaacacagattgcctgctacgctgcggcgacaggtctgatatgacgtgctgacgatgcttcgcgccagacgcgaaaccggctgaaagcgatgctaacagccggttttttactactggcggtaagcctgtttaatttgcttaaccgtactggaaaataccgccgcttgtgcttcatcatccatctgcgcgatctgtttttccattttaagaatcacgcgccctgcatcggcctggcccatcgcctgcagcatcagcgttaacatggctttcaggcagttgacttcagtagccagttcttgattattctcagcggtggaaaaatcaggcgtactcatttattttcctcgttatgtttcagtgaaaatgtgcgatagcagatgttaaggcggcggagtataccataagctacgctaaaaatagcagtggttgttttttgatcaaaaagcagaggggttacccacaaaataaacgttgccgcgtgatgcatatattttcttcattctttgtttattacgcgtattttactcgttaattattgttacaaagttgattccctaattagtgtttagacagcggaacgtgaaatttttgtcaccattatgaaatagcagcccggaacagcgccgtcagaaggggctacaacgttggcagttgccacatgacgtacaacataatttccaaaaacgagagcaaaatcgaatacccggtgtttttttacgtttcaaagttgagataaaaccagctaatataagggcgattaactatcagtagcgttatccctattctggagatattcctttgatcaacgttcttcttgttgatgaccacgaactggtgcgcgcagggatacgacgcattcttgaagatataaagggcattaaagttgtcggtgaagcgtgctgcggagaggatgcggtaaaatggtgccgtactaacgccgttgacgtcgtgctgatggatatgaacatgcccggtattggcggccttgaggcgacgcgtaaaattgcccgatcgacagcggatatcaaagtgatcatgctgaccgtccatacggagaacccgttgcccgccaaagtgatgcaggctggcgcagctggctatctcagcaaaggcgctgcgcctcaggaggtggtgagcgctattcgttcggtgtattccggacaacgttatatcgcctccgatatcgctcaacagatggcgctcagtcagattgagcctgcaaaaacggaaacgccgttcgccagtttgtctgaacgcgagttgcagattatgctgatgatcaccaagggccagaaggtcaatgagatttcagaacagctgaatctcagtcctaaaacggtgaacagctatcgctatcgtatgttcagtaaattaaacattcatggtgatgttgagctgactcacctggcaatccgccatggcctgtgtaatgcggagacgttaacaagccagtgagtgaaatatttgacgcaaaggcgttcctgaaaaccgttaccagccaacccggtgtctatcgtatgtatgacgccggcggtacggttatctatgttggtaaagcaaaagacctgaaaaagcgtctttccagctactttcgcagcaacctggcttcgcgtaaaaccgaagcgctagttgcgcaaattcaacacattgatgtcacggtaacgcataccgaaacggaagcgctgctgcttgagcataattacatcaagttgtatcaaccgcgttacaacgtgttgttgcgtgatgataaatcctatccttttatttttctgagcggcgatacccatccgcgtctggcgatgcaccgtggcgccaaacatgcgaaaggcgagtacttcggtccatttcctaatggctatgccgttagggaaacgctggcgctgttacagaaaattttccctatccgccagtgcgaaaacagcgtgtatcgcaaccgctcgcgtccttgcctgcaataccagattggccgctgcttaggcccctgcgttgcaggactggtcagcgaggaggagtacacgcaacaggtggagtatgtccggttgtttttgtccggcaaggacgaccaggtcttaacacagctgattgcccggatggaaaaggccagccaggatttggcatttgaagaggcggcgcgtattcgcgatcagatccaggcggtacgccgggtcacggagaaacagtttgtctccaatgcgggcgacgatctcgacgttatcggtgtggcttttgatgcgggtatggcctgtgtgcatgtgttgtttattcgccagggtaaggtactgggcagccgcagctattttccaaaagtgcctggcggtacggaactgggcgaagtggtggaaacctttgtcgggcagttttacctgcagggtagccagatgcgcacgctaccgggcgagatactactcgattttaatctgagcgataaaacgctgctggccgattcgttgtcggagcttgccggacggcgtattcatgtccagacaaaaccgcgcggcgatcgcgcccgctatctcaagctagcgcggaccaacgcggcaacggccttagtcactaaactttcgcagcagtccaccatcacgcagcgtttgaccgcgctggcgacggtattaaaacttcctgcgatcaagcggatggaatgttttgacatcagccataccatgggggagcaaacggtcgcatcctgtgtggtatttgacgctaacgggccgttacgcgccgagtatcgtcgttataatatcgcgggcatcacgccgggtgatgactacgcggcgatgaatcaggtgctacgtcggcgttatggcaaggccatagaagaaagtaagattccggatgttattctgatcgacggcggaaaagggcagctcgcccaggcgaaagccgttttcgctgagctggatgtcccctgggataagcatcgtcctttgctgctcggcgtcgccaaaggcgcggacagaaaagccggtctggaaacactcttttttgaaccggaaggcgaggggtttagcctgccgccggactcgccggcgctgcatgttattcagcatattcgcgatgagtcgcacgatcacgcgatcggcgggcaccgtaaaaaacgcgcgaaggttaaaaataccagtacgctggaaactattgaaggcgttgggcctaaacgtcgccagatgctgctgaaatatatgggcggtttgcaaggattacgtaacgccagcgtagaagaaattgcaaaagtgccgggtatttcgcaaggtctggcagaaaagatcttctggtcgttgaaacattgaggccactgtagcaacataggggtaatttcactgacaacagatagttacccgtcactatgcaatttaatatccctacgttgctcacgctgtttcgcgtcatcctgattccattctttgtcgtggtgttttatttgccgttcgcctgggcgccgatggtcagcgcgctgattttctgtattgccgcgattaccgactggtttgacggctttctggcgcgacgctggaaccagagtacgcgtttcggcgctttcctcgaccccgtcgccgacaaggtgctggtggcgatcgccatggtgctggtcaccgagcattatcatagctggtgggtgacgttacctgcggcgacgatgatcgcccgcgaaattattatctctgctctgcgtgaatggatggcggagctgggcaaacgcagtagtgtagcggtctcctggatcggtaaagtcaaaactaccgcgcagatggtggcgctggcgtggctcttgtggcgtccgaatatctgggtagagtatgccgggatcgcgcttttctttgtcgcagcggtgctaacattgtggtccatgttgcaatatttgagcgctgcacgcggagatttgcttgatcagtgatcgtttcgccgcaaatttcagcaaacgatcgtgagtgacgaaaaatatcgttgactcagtgcgtcaggtaagtagaatgcaacgcatcggacggcagcactgattgccagacgataacaaaatcaagcgattaacaaagttgcttgatactgcgggaatagctcagttggtagagcacgaccttgccaaggtcggggtcgcgagttcgagtctcgtttcccgctccagtttaaaagcattggcgtaaagcggatgctggctgaaaagccaaaaaaatttggcgcgttaacaaagcggttatgtagcggattgcaaatccgtctagtccggttcgactccggaacgcgcctccaatttttcccgagcccggatggtggaatcggtagacacaagggatttaaaatccctcggcgttcgcgctgtgcgggttcaagtcccgctccgggtaccatgggaaagacaagaataatcaaagcaataagcagtgtcgtgaaaccacctacgggtggtttttttgtgctttcagtttgtatgccgaccgcgagcgtgaactctccagcgcgatacacagtaaaaaacatcggtagcggcatttctgccagtacaacagttatgtgctaccgacccgcaagaacttatgcctggtaaatactaaacgtcgggtaaatcagccgataaaatccattaatctctataaaaaatgctgatatgttttatgcctgctttattaaagagagtaggtctgccagtgaaatataccgataatgcaaaattatttattagcttcattaatattgggattgtaagttgcgctttgctacttttttattttgtatgagcctgagagtgcaatcgtaacctactctcttcccggtgagctttcctcttcgacatgtgatgcacataattttattggctacgtcgatgcaaatgactttgcagagtatataaaaaaagtagaactgacgcgctacaatatgtattgtctgaaaaaaacaggggcaggccagtggagtatttatgcaaattaaacgagtatataactgttcaggggtattttctgcacaatttaattaaaggtagatagcgaactaatattcatcactaggtaatgtgatccgcttcatgctttaatcacgttttgcaatattgtcttaataacaggtcaactacagataatttcgggttttcgtgaatggcggttttggtcagtctctatattatgctttccccgctttacggagatgatgatgcaaaagaaaacctgggccgttttattgataccattgtgcctcaccgcttgccaccagacgaccaaccgatcaacagccaaagatgaaattctcacagggagctatattgacccgacaaaaacacgctttccgttagcggattattcacagtcggttgataaatggatacctccggactcggctgattacactattccggttattgatagtgctacccaacaacgctactttagcgcactaaaatctcattatttcggaatggacagtgaagcgcactcgccgtggaatgatttttatattaccgcattgctgaaaaaaaacgcagcacaggcccgggatgccagtattaagcagtttcttagcgacggcagtgcttattggggggaaaacttcagactttatacctctcgctggaaagaggaggttagagggaatacggatacgcagattgacaatatctatcatgcctcccggcgaggcattatggtcagagaaagtttagtcagagcgctgccaacggacgacccgctctttaacgatccccgtcaggcgggcgaggggtacccgtttgataatttacaaatgtcttcgctgcgtcccggtacgccggtctatacgctgacgaagagcaaagaccaacgctggcaatatgtcgtttcaccagcggtaactggctgggttcacagtgaagatattgccagtacggatcagaaatttataacacagtgggttttgctcgctcacaagcaactgggggcatttatcaacgcgccggtttctgtccatgccgcaggcgtctattatttcaccgggcgaccgggtactattttaccgttccgacatcaacgggcgggccagttcctgattgcggcgccagttcgcggcagcaacggtcgcgcgtttatccattgggtctggctaagcggtaacgagtttacggctatgccgtggaaaatgacgccggaaaatatcgccgtgctaatgaaagcaatgcacggcgccccctacggttggggaaattttaacttttataatgattgttcagccgaagtccgcagcctgttaatgccgtttggcatattcctgcccagacattcatccgcgcaggtagagtctgctggacgggtggtcgatcttagtcataaaaatccccaaatgcggatcgattatctcaccagatacggaaaagcgtttactacgctggtctatattccagggcatattatgctgtatatcggtaacacaaccatgaatgggcaggtcgtgccgatgacttatcagaatatctggggattgcgcccaaaccatgctaatagccggagcattatcggtgaggcggtatttttgccgttactgcgtttttatcctgaaaatcctgagctgatatcgctggctggtaaggttctgtttaagcttggttatatagaataggttgacaaactgtgttatcgcggaagacatgattaaggcaaccgtgcgcgtggatataaagatagtatccctgtaaactgtgtctgaaaaaagtatacgctatagtgcgggctgtttatttgaaatactatctggagctgattctggatgtgattatgtgcctcacacattgaagtgagagttattgttggcggtatctggctggaggctgggtggtaaaaagacgtaatttattgcattttaataacggtgcccggtcagagcgcgatcttggggatctggtcactaaagtttttgagaaagcggcgaaaaaagaaccgcaaccgctatacacatttagcctgccgttgctgagtgtgcaagatgagatccgtgtttactgtaagaaaaaaatatcaaaatagggtacgatacgctgtttatggaaataaccttttctgctgacagagaagcggtagacgaactcattaaacacttttttactgaaaataagctctatttgagagggcggttttatctgtccgcggcggtggtataagttagcatgagtataatatagcgagaaacctatctctcacttttgtgtggggcgagcgcttcctggcggaaaatctgcgccctgatcctccttttgtgcgttaacttccggaatcctcctcatttcgtgttaatctggcccctgatggttgccatccaaactgcctgcaaaaaaattatttttatccgctgcaatgtaagaggcctacaggcggaagtcatcactgaggaaaagcattatgaaaatggaaccattaaacgagaacgagctggaatggctggatgatgtgctgacgaaatacaataccgatcaggtcattttggatgtcgcggagctggacggtctgattactgcggtactaagttctccgcgtcccatcgagccggaacagtggctggtcgcgatatgggggggacccgcgtacgtaccgcgctggacatctgaaaaagaaatgacgcgatttatggatctggtattccagcacatggcggacacagccgcccggcttgaagactatccagaacagttcgagccgctgtttggcctgcgagaagttgatggccatgaattaacgattgttgaagaatggtgctttggttacatgcgcggagtgtcgctgtccgactggtctgacttgccggatacgctaaaaccggcgctggaagcgattgccttacacggcacggaagaaaactttgcgctgttggataaaatgagcccggaagcgttcgataaaagcgttgacgctatccgtatcgcggcgcttgagctgcatgcctggtggatggcgcatccgcacacgacgccgctacagatgccgataaaagcggaggtgaaagtggggcgtaacgatccttgtccatgcgggagcggcaaaaaatttaagcagtgctgcctgcattaatggctcgtaaacggccatagcgtgatgattatcgagcctggacggcgtccgggcccggtaatctttgcctggcgttaacctggatcgggcaggaaccccagtgcgatcgaaaactggacgccaatcacgacaatgccgcagataaacaccagcgccagcgctggcgtgccgcctgccacacgatatcccgcctgagggctctgtttacggcattgccagaccagcatggcagggatgagtagtgccagcactgccagcgctacgccggcatagcctaatgccatcacaaatccacgtgggtagaaaagcgcaaacgccagcggcggcagaaaggtaatcagcccggtttgcaggcgtccggacaccgtactgcggcgctggaatagatcggccaggtaatcaaataatcctagcgctacgcccagaaaagaggtcgccagcgccagatcggcgaacaggtggaccgccagttcgacatgtggcgaagcgaccacttctctgagcgcctgcagcaggccatttaacccggcatggctggccagtagccctctgaatgtcggcgagtcgatacttcccagcgtggcgagctgccaaaaaatataggccactagcggaatggcgctacccgtcataaagacccaacgcagccggcgaatgttgccgttcatataactcacaatactcggtacgcttccgtgaaaaccaaacgaggtgaaaatgaccggtatggcggacaatgccagcccctgctgtaaaggaagcgtaagaagatttactttatgaatatgtggcgtgagcaacgcaagcatgatgaccagaaaaatgatcttcgcgctaaacaggaagcggttaaaaaggtcgaccagcgaggtgcccacacacaccaccccaccggcaacaaaggtgaacagcagcaccccggcagcgggcgagagcgtggcgccaagccagttattaatactggatgccagtaattctccggctccggaaatgtaggcggcggtgagcgcatacattaagaacatcatgctgaatcccgtaagccactgtccgtaacgtccaagatagcgttttgccaacgagcccagcccggtatccgccggaacatgttgatatacttccagtaatagtagcgcggtataacacatcagcgcccacagaccaatcaacaatcccagcgtgacgctgaaaccaacgccagccgctgccagcggcattgccagcatcccggcgccgatagtggtgcctgccacgataaaaatactgcccagagttctgtttttcacgctttctactaccccggtaacaaagaacggtgatatccgcggcgcagggtaaggcattacgctattttcgtcaaatggtcgttacaataggtgtactggaaattttacagttccgggcataaaagcgaatatgggaggagacgcggacaaccgccgcaaacctgcgctagcgcaaagtcgctcgcacaaggacacattaggctacaagttttattcaggagggcttatggattccattcacggtcacgaagtactcaacatgatgattgagtctggcgagcagtacacgcatacctcgctggaggcggcaataaaagcgcgctttggcgagcgggcacgatttcacacctgttcagcatcagatatgacggcggcggaactggtcgcgtttctggcggcgaaaggaaagtttattgcggtggaggacggtttttcaacgcatgagagtaaaatctgccgccattaatacgccacggtgagagcgcgtctcaccgtgtaaggacgtgctggattaattttgcgtatccagggtggagagttctttatcaatgaaataaagcccttcgccgctttttcccgccagcgttaatttatcaataatagatttgaacagtttttcttcttcatgctgttccgccacataccactgcaagaaattaaatgtcggataatcctggctggtcattgcggcatgagccagttcattaattttttgcgtaataagctgctcatgctcataggtcgcgcggaacagttcatccagtgaggtgtactcagcgaagggcgaagaaacgctattaatgcgcggcaggcttccggtatcggtaaggtagtcaaacaggcgctgcatatgcgtcatctcttcttgcgcatggcgacgaagaaatgcggccgcgccttcaaaactgtgatagctacaccacgcgctcatttgttgatagagcagggaggagtacaactccagattcatttgctcattcagtttgtcgatcatttctgttttcagcatggttccgctccacaaatagcaaaagatatacggtaatgtggcgccactataatttgttattttattatttgcaaaaggtaaaatattaaatttaattattaaaaatacgaatgggaataaaacgcattaacgccagtgtatagcgtataaaaataaaggaaagccagcaccttcatgctggcaatagcgaccctgcactctcctctattgtacatggtgtcggcgttaagccagccgccttaataataaagcggcatgatttgcgggacggaaacgccccggcactgccaggagagggtaaatcgggtgttcagacacaacgagcccgcataaatgctacaggttcctaccggctgaccaaacgaaacggcatcggcatagcccatctgctggcattcgcgtgttgcggttccgtgagatacatagtcatctgtccgtgaagtaaaaaatagcggctggttatacgtcaggcgcacgatgccgcttatcgggctggcttcgctgacctgcgcttgtcgagtaatggtgcatcccgtcagggctagcagtgaaagagtaaaaataagaggcttcataaaatcgctccgacagttcggtatcagaccatgctacctcgtgtcttgcaccgtcaatggctggaataacttacggattcgccttgattaaaggtaacggcaggggatttacagcgggaacagaaaatgtgtgagcgtcttttcatttaatgaaactttgtttcattaaatttgaatgtgtgttcgtaaatgtgtagtgtaggcaaaacgtcatgatttatgcaggcgccacctctggcaaacagaccagaaacggtgtaggccggataagctgcttcgcgttgctatccggctaataacgtctcaatattgtcgctcggggtgccgctatcagtgatgctgataggtcacgacgttaaggagatgctgatcggtttgcgccaggcatagccctgctcgtttagcgctgcgaacttcttcgagaatagtttgtaaaagtacgccatcctgctgctgctctttttccagggtatggagaaaatcgagcgttgaggcatcattcagcgctttcgcttcatctgccagacgcgacagcgtgctggcgcgttgctgataatcctccagggttttctggaacaattcttccagagagcagagctcttcacccggaacgtcaatggctttaacgataggggtggcgccggcgtttttcataaaattaaacatgcgcatcatttgcgtcacgttgccttgcgcttgggtacgaagaaaggtggctgtacctgttaaactgtgttcagaacaccattcgcttagatggaggtaaagatttgatgcgtaaaactcaagattcattggcgtgttgagcttttgaaccattcctacagctgccataacaatatccttatttccagaaagtgttgatgtgcatgacagacgagaatgcaacggatcgttgtcacattcttacctctatgcacaataaatactcttagcagaagaactccgttccgccagtcccttatgcgatctcatttcctgtttatcgatcggtaatgagaatagcgcgtcaatgaaaataagaaaatccttaaatgcaattgtttatctttttttacattttcagctgtgtgattttttcatcagaaatgatttttggtatgtcattcttataactatttgaaagataaaagatattctattttttctggtttatgaaacattgtttcagatcataagataggcctttcaagtatggtaatttcaataaaataaacattagccagtctggatatcacacgcataaacggttgagagcaaatatgcctgtttttataaactagccgattttgcggtagatcatttttaatatcattaatcatacgagcacgttattcggttgagcgcagttttgctgggtgactcgttaacaaggagcagtcaatgaaaaaggtcgcggtgctactggcgccaggatttgaagaagcagaggccattgttactcttgatattctgcgacgtttgcatatcgacgtcgaaacgctggcgtgtgctgaatcacgggcggtggtgagttaccatgatattcctatggttgcggacagcacgctgagtgaacgccagcaggcgctttttgatgcggtagtgctgccgggcggtccgcaggggagcgctaatctggcggctaatccggcggtgatcgctttcgttgcgcgtcatgatgcggcaggcaaattaatttgtcctatctgttccgcggcggcaagggtgctgggtgctcacggattgctgaaggggcgtcgttatgtctgttccggcgacctgtggaaagcggttccggaaggtgtctatgtggatgcgcccgtggttgaagatggtaatttaattagcggcaaagggttgggtcatgtctttgatttcgcgctaaccctttccgccagactgctgggagacgatgcgctggttcgcgaacaagctgaacatatctattatccctggtaatcgttattcacccagggccgtaaggattagctggctgatgttatggattaatgtgctggctttcctgccttttggctgatgaattcgctctgggttatgtcattttccgctaaaactattccagccatcagcatttatctaatgaatgaaagacagtgcaccgttttacgtcttctctaacaagaatcgtttgattttaccctacataaaaaacgctaaagcaggtcaatgaattccctgggttatgagttaatcgttatttctgcgtgcgtattagggggcgttttcctgagaggcggcctcggaaaaatctcatatgtggtggcgagcgtactgatatcaggaacggtggagaacgcgatgaacctgctcaacatttcaccttttgcacagtacgtggttcgcggctgaatccttctggcagcagttatcttcgaccattataagcaaaaagcgaagcgtatgatttgatgaattaacactcaactaaacagtatagcttcacgtcatcgccaaccgctaccccggctggcgatggtctttctaaatggcgagcagcgtcacactgtctatacttacatgactaatgagaccgtttgtgagtctcaatatgatgataaggaggagaccagggtggcagaaccgttaaccgtatcccccgaactcactgcgaactatgcgtatttttttgaccttgatggcacattggcagagataaagcctcatcccgatcaggtagtggtaccgcataaaatccttcagttgttagaccgtctcgcggcgcacaacgcaggggcactggcattgatttcagggcgttcaatgactgagctggatgctttggcgaagccttttcgctttccgctcgctggcgttcacggggcagagcgtcgtgacatcagtggtaaaacccatatcgtgcgccttcctgaagcggtagtccgtgaggtggaggcgttattacgttcgacgcttgcagcgctgcccggaacggagctggagacaaaggggatggcgtttgcgctgcactaccgtcaggctccggaacatgaagcggcgctgttggcgcttgcgcaacacgttacgcagcactggccgcaactggcgttgcagcctggtaaatgtgttgtggaaatcaaacctaagggaactaataaaggcgaagcgattgccgcctttatgcaggaggcgccctttacgggacggattcccgtttttgtgggcgacgatttgaccgatgaggctggctttggcgtggtgaatcacgctggcggaatttccgtaaaagtgggcgtcggggcaacccaggcggcatggcggctggaaagcgtacccgatgtctggcgctggctggaacaaatcaattatccacaacaagaacaacaagtaatgaataacaggagagatggctatgagtcgtttagtcgtagtatctaatcgaattgcccccccggataataaaggcggcgccggcggcctcgctgttggcgtgcttggcgcgctaaaagcggctggcgggttgtggttcggctggagtggcgagacaggtaacgaggatgagccattaaaaaaggtgacaaaaggtaatattacctgggcatcgtttaacctgagtgaacaagattacgaagattattactgtcaattttccaatgcggttctctggccagcgttccactatcgtctggacctggtacagtttcagcgtcctgcatgggaaggctatatgcgggtgaatgcgttattagcggataagttattgcccctcattaaagagaacgacatcatttgggtgcatgactaccacctgttaccgtttgccagcgagctgcgtaaacgcggcgtgaacaaccgaattggttttttcctgcatattccattcccgaccccggagatttttaacgctttaccgccacatgatgaactgctggagcagttgtgtgactttgatctgctcgggttccagaccgaaaatgatcgcctggcttttctggatagcctttcgagtcaaacgcgagtcacgactcgcagcggcaagcagcatatcgcgtggggtaaagacttccagacagaagtgtatcctatcggtattgagcccgatgagattgctctgcaggctgccgggccgttgccgccaaaactggcgcagctcaaggcggaactgaaaaatgtgaagaatattttttccgttgagcggctggattattcgaaagggctgccggaacgttttctggcgtatgaagcgctactggaaaactatccgcagcatcggggaaaaattcgttatacccaaattgcgcctacgtcacgcggcgaagtacaggcatatcaggatattcgccaccagcttgagacagaagcaggccggattaatgggaaatatggacaattgggctggacgccgctctattatctgaatcagcatttcgaccgtaaactgttaatgaagatattccgttattcagacgtcgggctcgtcaccccgttgcgtgacgggatgaacctggtggcgaaagagtttgtcgccgcgcaggaccccgctaatcctggcgtactggtactgtcacagtttgccggcgcggcgaatgaactgacgtcggcgttaatcgtcaatccttacgatcgggatgacgtggcggcggcgctcaatcgtgcgttaacgatgccccttgccgagcgtatttcgcgtcatgcggaaatgctggacgtgatcgttaaaaatgacattaaccgctggcaggagcgttttattcatgacctaaaggaggtcacgccgcgtagccctgagcgtcagcagcagaacaacgtggcgacgttccctaagctggcctgagatatcgcgagcggcgactagtcgcccgctaacggcaccagcaacacatctacctggctggcgctgacgacacttttgccgagcaggacgcgcgcgaaaagaaactgtggttatggttgccgcaaatgaccagatcaacatggtgtttgcggcacacagccaaaatatgctggcttaactcacctgatgcgatgaaagtttgttcaatcggataatccgccttttcccccagcattttaagaaaattctcggtctcttcatgcataaccgcgcgtaaatcctccatcatgggcgcggcgaactggttatacagttcaggatcggaagcgagagtaatcaggcttactttcgcctgaacagggcgggcgatagagaccgctttagccagtagctggtgactttccggggtgacggcaacggcgacaagaatatgggtgtagctcataactcgctccttgattgcaagaatatgagattgtgctttagctttactctgtttatcgcatttctgcaatgcgctaatgccacattaatgtgaaggacatcataattaatcattgattattcttatgtaaagaatcgtggcataagacactttttacacaccaccaggatgctttatttaaacgggtgaacaaggaaagctaaaagttaaatcaaatgagcttatttttaacagaggagggcgtatgctgtgacgagattaattaataacgtttaatatttaagccactgtttactaaaggtaaaataaaattgtttctaaaatagaaataatagcctgttatctattatcctggcgttattttaacagagagaaacaaaaaagaatttggtgttgacgtacccctattcagcagtgtggaatagaaaaagtgaatattaggttattaattaaacaaagtaaaagccatactgatggttttatcgtaagtattctgttaaattatgtgatctgcatcgcatattttctaaaatcgccgtcccgctccgttgtatgtcacgaaactgacgagtagagttgcgtcgaattaggaaaaatcttaggcatttgtaaaaattgatgtaaacgtgtaaggcgaatcccagtgggaagctgcgttatacgtcacaatgtccataatgtctgagcgctgctatgcatttgacctttttgcttcttttaccgggccttcccggcgacatcacggggtgcggctacgtcgcacaaaaataaagttggttattctggatgggaacaatgcatacatccgagttgctaaaacacatttatgacatcaatttgtcatatttactccttgcacagcgtttgatcgtccaggataaagcatctgcgatgttccgcctcggtatcaacgaagagatggcaaacacactgggcgcgttgaccctgccgcagatggtcaaactggcggagacgaaccagttagtttgtcatttccggtttgacgatcatcagacgatcacccgtttgactcaggattcgcgcgtcgatgacttacagcagattcacacaggtatcatgctttcaacgcgtctgctcaatgaagtggacgatacggcgcgtaagaaaagggcatgataatgagcgaaaaaagcattgttcaggaagctcgcgatatccagttggcgatggagttgattaatcttggcgctcgtctacaaatgctggaaagcgaaacacagctcagccgtggtcgcctcatcaggctgtacaaagaattacgcggtagcccgccgcctaaagggatgctgccattttcgacagactggtttatgacctgggagcaaaatattcatgcctccatgttctgcaacgcctggcaatttttactgaagaccggcttatgcagcggtgtggatgcggtgattaaagcttatcggctttatcttgagcagtgtccgcaaccgcctgaagggtcgttgttggcgctgactcgcgcatggacgctggtgcgttttgttgaaagtgggttgcttgaattgtcgagctgtaactgctgcggtgggaactttattacccatgcgcatcagcccgtaggcagctttgcgtgtagtttatgccagccgccatcccgcgcagtaaaaagacgtaaactttcccgagatgctgccgatattattccacaactgctggatgaacagatcgaacaggctgtttaaccgaaacggtgtggacaaacactccagcagcggtaagccattaccgctgctttttttttttgccttgccttcgcgttaatcgcccgactgcgcatcctgtcatagtcaacagcggaaggatgatgtcgtgcttatcttattaggttacttggtggttatcggtacagttttcggcggttatgtcatgaccggcggacaccttggggcactctatcaacctgctgaactggtcatcattggcggcgcggggatgggggcgttcattgtcggcaacaacgggaaggccatcaaaggcacgatgaaagcgatcccgttgttatttcgccgttcgaaatacacgaaatctatgtacatggatttgctggcgttgctctatcgcctgatggccaaatcacgccagcaggggatgttctcccttgaacgcgatattgaaaatccgaaagagagtgaaatcttcgccagttatccgcgtattctggccgatgcggtaatgcttgattttattgtcgattatctgcgtctgatcatcagcggcaacatgaatacgttcgaaattgaagcgttgatggatgaagagattgaaacccatgaaagcgaggcggaagtcccggccaacagtctggcgatggtgggggattcgctgcctgcctttggtatcgtcgcggcggtaatgggggtggttcacgctctggcttcagccgatcgtccggcagcggagttgggggcgctgattgcccatgccatggtaggtacgttcctcggtattttactggcttatggattcatttcaccgttagcgaccgttttgcgccagaagagcgccgaaaccactaagatgatgcagtgcgtaaaaattacactgctgtctaatctgaacggctatgcgccgccgattgccgtggaatttggtcgtaaaacgctttattccagtgagcgtccatcgtttattgagttggaagaacacgttcgcgcagtgagaaacccaaaccagcagcagacgactgaggaagcatgaaaaatcaggctcatcccattgtcgtcgtaaaacgccgcaggcacaaaccgcacggcggcggggcgcacggttcctggaaaattgcctacgccgattttatgacggcgatgatggctttttttctggtgatgtggctgatttccatctccagccctaaagaattaattcagattgccgaatattttcgtacgccgttggccaccgcggtaacggggggaaatcggattgccaatagcaagagcccgataccaggcggcggcgatgattacacccaacagcagggtgaagtggaaaagcagccgaatatcgacgagctgaaaaaacggatggagcagagtcggttaaacaaactgcgcggcgatctggatcaactgatcgaatccgatcccaaactgcgcgcgttacgtccgcatctgaaaattgatttagttcaggaggggttgcgcatccagattatcgacagccagaaccgcccgatgtttaaaaccggcagcgccgaagttgagccgtatatgcgcgatatcctgcgtgcgattgcgccagtgttaaacggtatacctaatcgcattagcctggccggccataccgatgactttccctacgcgaacggcgaaaaaggctatagcaactgggagttatccgccgatcgcgccaatgcctctcgtcgcgaactggtcgctggcgggctggataacggaaaagtattacgggtggttggcatggccgccacgatgcggctgagcgatcgcggtcctgatgacgccatcaaccgccgtataagcctgctggtgttaaacaaacaggcggaacaggccattttgcatgaaaacgctgaaagccagaatgagccggtaagtgtattacaacagcctgcggcagccccgccggcaagcgtacccacatcgccaaaagcggaaccgaggtgatagcgtgagcatggatattagcgatttttatcagacattttttgatgaagctgacgagctgttggctgatatggagcagcatctgctggatttggtgccggaatccccggacgctgaacaactgaacgccatttttcgcgcggcgcactccattaaaggcggcgcgggcacattcggcttcactattctgcaggaaaccacacatttaatggaaaacctgctggatgaagcccgacgcggtgaaatgcagctcaataccgacattatcaacctgtttttggaaacgaaagatattatgcaggaacagctcgacgcctataaaaactccgaagagccggatgccgcaagcttcgaatatatctgcaatgcgctacgccagttggcgctggaggcgaaaggcgaaaccacgccggcggtcgtagaaaccgcggcactaagtgcggcgatccaggaagagagcgtagccgaaaccgaatcgcctcgtgacgagagtaaactgcgcattgtactttcacggttgaaagccaatgaggtcgatctgcttgaagaagagttgggcaatctggctactctgacggatgtcgttaagggggcggattcactgtcggcaactctggatggcagcgtcgcggaagatgacattgtcgcggtgctctgttttgtcatcgaggccgatcagatcgcttttgaaaaagtggtcaccgcgccggttgaaaaagcgcaagagaaaaccgaggtagcaccggtagcgtctccggcagtcgttgcgccagccgccaaaagcgcggcccatgaacatcatgcggggcgtgaaaaacctgcgcgtgaacgcgagtccaccagcattcgcgtggcggtagagaaagtggatcagctcataaacctggtcggcgagttagtgattacccagtcaatgttggcccagcgttctaacgagctggacccggtaaaccacggcgatctcattaccagtatggggcagttacaacgtaacgcccgcgacttacaagagtcggtgatgtcgattcgtatgatgcctatggagtacgtcttcagccgtttcccgcgtctggtacgcgatttagcgggcaaactgggcaagcaggtagagctgacgctggtggggagctccactgaacttgataaaagcctgatcgaacgcattatcgacccgctgacgcacctggtgcgcaacagtctcgaccacgggattgaaatgccggaaaaacgccttgaggcggggaaaaatgttgtcggcaatctgatcctttctgcagaacatcagggcgggaatatttgtattgaagtgaccgatgacggcgcggggcttaaccgtgagcgtatcctggcgaaggccatgtcgcaggggatggcggtgaatgaaaacatgaccgacgatgaagtaggcatgttgatcttcgcgccgggattctcaactgcggaacaggtcacggatgtctccggtcgcggcgttggcatggatgtggtgaaacgtaacattcaggagatgggcggtcacgttgagatccagtcaaaacaaggctccggcaccacgattcgtattctgctgccgctgacgctggccatcctcgatgggatgtcggttcgcgtggcgggggaagtttttatcctgccgttaaatgcggtgatggagtcgctgcaaccgcgtgaagaggatcttcatccgctggcgggcggcgaacgggttctggaagttcgcggcgagtatttgccgctggtcgaattgtggaaagtgtttgacgtggacggggcgaaaaccgaatccacgcagggcattgttgtgatcctgcaaagcgcgggacgccgttacgcgctgctggtcgatcagctcatcggtcagcaccaggtggtggtcaaaaatctggaaagcaattatcgcaaggtaccggggatttccgccgcgacgatcctgggcgacggcagcgtcgcgctgattgttgatgtttccgcattgcagggtttaaaccgcgaacaacgtatggcgatcacagccgcctgattgagtgagaagggaataatatgaccggtatgagtaatgtaagcaaactggccggcgagccgtcaggtcaggaattcctggtgtttacactgggaaatgaagagtacggcatcgatatcctgaaagtgcaggagatccgtggctatgaccaggtgacgcgcatcgccaatacaccggcctttataaaaggggtgactaacctgcgcggcgtgattgtccccattgtcgatctgcgcgtgaaattctgcgaaggcgacgttgagtatgatgacaatacggtagtgatcgtactgaatctggggcaacgtgtcgtcgggatagtggtaggcggcgtgtctgacgtactgtcgttaacggcggaacagatccgtccggcgccagaatttgccgtgaccttgtcaacagaatatttgacgggattgggcgcgctcggcgagcgtatgctgattctggtgaatatcgaaaaactgcttaacagcgaagagatggcgctgctggatatcgcagcatcacacgtcgcgtaataacgttgccggatggcgtcgcgccatccggcaatattcaccgttatgcttccgccagcggtgagagtgcctcttcatcgcccgcgcccagcccctgcattttgcgccggcatcgccgctgcgacactgtcattggcaatgtcgtcttccggaacagcgtatttcctttttgcaaaagtaaagttatcaccgcaggtgccgataacgttgataactcgttatcaggaaggtgccttatgtttaaccgtatccgcgttgtcacaatgctgatgatggtgctgggggttttcgcactgctacagcttgtttccggtggtttgctgttttcttcattacagcataaccagcaaggttttgttatttctaacgaattacgccagcaacaaagcgaactcacgtcgacatgggacttaatgctgcaaacgcgcattaacctgagccgctccgccgcacgcatgatgatggacgcttctaaccagcagagcagcgccaaaacggatttactccagaatgcaaaaacgaccctcgcacaggcggcggcgcactacgccaatttcaaaaacatgacgccattgccagcgatggcggaggccagcgcgaacgtcgatgaaaaatatcagcgctatcaggccgcattagccgaacttattcagtttctggacaatggcaatatggatgcctacttcgcccagccaacccagggaatgcaaaacgcgttgggcgaggcgctgggcaattacgcccgggtgagcgaaaacctgtaccgccagacatttgatcaaagtgctcatgactaccgttttgcgcaatggcaactgggggttcttgcggtcgtgctggtgctgattttgatggtggtttggttcggcattcgtcatgccttgcttaacccattagcgcgagtgattactcatatccgtgaaattgccagcggcgatctgacgaaaacgctcaccgtctcaggacgtaatgaaattggcgaactggcgggaacggttgaacatatgcaacgctcgctgattgacaccgtgacgcaggtttgtgaaggttcggatgcgatttattccggcaccagtgaaattgccgccggtaataccgacctctcttcccgtaccgaacaacaagcctccgctctggaggagacggcggccagcatggaacaactgacggccaccgtgaagcaaaacgccgataatgcccgtcaggcttcgcaactggcgcaaagcgcctccgagaccgcgcgtcatggcggcaaagtggtcgacggcgtagtaaacactatgcacgaaattgccgacagttcgaaaaaaatcgctgacattatcagcgttatcgacggtattgccttccagactaacattctggcgctgaacgcggcggtagaagcggcgcgcgcgggagagcaggggcgcggttttgcggtcgtggcaggcgaggtgcgtaatctggccagccgcagtgcccaggcggcgaaagaaataaaagcgttgattgaagattccgtctcgcgtgtcgataccggttcagtgctggtggaaagcgccggggaaaccatgactgacatcgtcaatgccgttacgcgcgtcacggatatcatgggcgaaatcgcctccgcctcggatgagcaaagccggggtatcgatcaggtcgctttggccgtttccgaaatggatcgcgtaacgcaacagaacgcctcgctggttcaggaatccgcagcggccgccgccgcgctggaagagcaggccagccgtctgacccaggcggtatcggctttccgcctggcatcgcgaccgctggcggtaaataaacctgagatgcgtttatcagtggacgctcagtccggcaatacgccgcggcccttagccgccggggatgatgcgaactgggaaaccttctgatcgatgtgcgctgtgtgctgtcggttatcgattaatttgcgaacccgccgatccctttcgtctggttcgcatagataaaagcaaaaaatgtgtaatacgggaagcatggcgctgccgcagggcgcgcccgttgtactttgaatgtgattaagaaggcgctatgacatcatctctgccctccgggcaaacgtcagtattgttacagatgacacagcgcctcgcgctgtccgacgcgcattttcgtcggatatgtcaattaatctaccagcgtgcagggatcgtgctggccgaccataagcgggatatggtttataaccgcctggtccgtcggctgcgtgccctgggactggatgattttggccgttatctcagtatgctggaggctaatcaaaacagcgttgagtggcaggcttttatcaacgctctgactaccaacctgaccgctttttttcgcgaggcgcaccattttcccatccttgcggaacatgcgcgtcgccgccacggcgagtaccgcgtctggagtgcggcggcatcgacaggagaagaaccttacagtatcgccattacgctggcggatgcgttagggatggcccccggtcgctggaaagtattcgccagcgatattgatactgaagtgctggaaaaagcgagaagcggtatttatcgcctcagcgaactgaaaacgttatcgccgcagcagctacaacgttacttcatgcgcggtacggggccgcatgaaggactggtgcgcgtgcgtcagcaactggccaattatgttgaattttcctccgttaatttattggaaaagcagtacaacgtacccggtccctttgacgcgattttttgccgtaacgtcatgatctattttgataaaacgactcaggaggacattctgcgccgttttgttccactccttaaacctgacggactgttgtttgccggtcactcagaaaactttagcaacctcgtgcgcgagtttagcctgcgcggacagacggtgtatgcgctaagtaaggataaagcatgagtaaaatcagggtattgtcagttgatgattccgcgctaatgcgccaaatcatgactgaaattattaatagccatagcgatatggagatggtagcgactgcgccggacccgttggtcgccagggatctcatcaaaaaatttaatccggacgtattgaccttggacgttgagatgccgcgtatggacggcctcgattttctggaaaaactgatgcgcctgcgaccgatgccggtggtgatggtctcttcgctgaccgggaaaggttccgaagtgacgctacgggcgctggagttgggggccatcgattttgtcaccaaaccgcagcttggcattcgtgaaggtatgctggcgtatagcgagatgattgccgaaaaagtgcgtaccgccgcgcgggcccgcatcgccgcacataaaccgatggcggccccgacaaccttaaaagccggtccgctgctcagttcggaaaaactgattgctatcggcgcttcaacgggcggtactgaagctatccgacatgtgctgcaaccgctgccgctttccagtccggcagtgattattacgcagcatatgccgcctggctttacccgctcgtttgccgagcgcctgaataaactctgtcaaatcagcgtgaaggaggcggaggacggcgaacgcgtattgccaggtcatgcctacattgcgcccggcgacaagcatatggagctggcgcgtagcggggcgaattatcaaatcaaaattcatgatggcccgccggtaaaccggcatcggccttccgtggatgtgctgtttcattcggtggcgaaacacgcggggcgcaacgccgtaggcgtcattcttacggggatgggcaacgatggcgccgctggaatgttagcgatgtaccaggctggcgcctggaccattgcgcaaaacgaagcaagttgtgtggtgttcggcatgccgcgcgaggccatcaatatgggtggcgtaagcgaagtggtcgatcttagccaggtaagccagcagatgctggcgaaaatcagtgccggacaggcgatacgtatttgaaccaggagtagtattttatggcggataaagagcttaaatttttggttgtggatgacttttcgaccatgcgtcgtatcgtgcgcaacctcttaaaagagcttggatttaacaatgtggaagaggccgaagacggcgtcgatgcgctgaacaagctccaggcaggcggctttggttttattatctctgactggaacatgccgaacatggatggcctggagctgctgaaaaccattcgcgccgatagcgccatgtcggcgttacccgtgttgatggtcacggcggaagccaagaaagagaatattatcgccgccgcacaggctggcgccagcggttatgtcgtaaaaccgttcaccgcagcgactctggaagagaagctcaacaaaatctttgagaaactgggcatgtgaggatgcgatgatgatgcaaccatctatcaagcctgctgatgaaggctcagcaggagacatcattgcgcgcatcggtagtctgacccgaatgctgcgcgacagcctgcgtgaactggggctggaccaggcgattgccgaagcggcggaggcgatccctgatgcgcgcgaccgtctggattatgtcgtccagatgacggcgcaggcggcggaacgcgcgctaaacagtgtcgaagcctcgcagccgcatcaggatgcgatggaaaaagaggcgaaagcgctaacccaacgttgggacgagtggtttgacaatccgatcgagctttccgacgcccgtgaactggtgacggatacgcgccagtttctcagggatgtcccgggccataccagctttactaacgcgcaactgctggacatcatgatggcgcaggatttccaggatctgacgggtcaggtgatcaaacgcatgatggacgtgattcaggagattgagcgccagttgttaatggtgctgctggaaaacatcccggaacagagcgcgcgaccaaaacgcgagaacgaaagcttgctcaacggcccgcaggtggatacctcgaaagctggcgtcgtcgccagtcaggagcaggtggacgacctgctggacagtcttggcttttaagcttttttgacctgatggcgctgcgcttatcgggtccgaatccgtcaacccggccggatacgatactttcttatcgtatccggctatctctattaacgccataaaccccgccttttttaccgcttactctgcccattggcgtaaagcggttctggcatcattctcgcttatcaatctatccagggtttgctgcgtggcagaagagagcgacgacgacaaaacagaagcccccacaccccaccgacttgaaaaagcgcgggaagaagggcagatcccccgttccagagaactgacctcactgctgatattgctggtgggcgtttgtattatttggttcggcggcgagtcgttagcgcggcagctggcgggaatgctctcagcaggcctgcacttcgatcaccgtatggtgaacgatcctaacctgatcctggggcagataattttgctgattaaagcggcgatgatggcactgctaccgctcatcgcgggcgtggtgctggtggcgcttatctcgccggttatgcttggcggcctgatttttagcggtaagtcgctacagccaaaattttctaaattaaacccgctgccgggaattaagcgcatgttttcggcgcagaccggcgcggaactgctaaaagcggtgttgaaatccacgctggtcggctgcgttaccggcttttatctctggaatcactggccgcaaatgatgcgcctgatggcggagtcgccgatcgtcgcaatggggaatgcgctggatctggttggactctgcgcgttactggtggtactgggcgtgatcccgatggtgggatttgacgtttttttccagatctttagccacctgaaaaaattacgcatgtcgcggcaggacattcgcgacgaatttaaagagagcgaaggcgatccgcatgttaagggcaaaattcgccagatgcaacgcgccgccgcgcagcgccgcatgatggaagatgtgccgaaagcggacgtcattgtcactaacccgacgcactattccgtggcgctgcagtatgacgaaaacaaaatgagcgcgccgaaagtggtcgcgaagggggctggattaatagcgctgcgcattcgcgagatcggcgctgaacatcgggttcccactttagaagcgccgccgctggcgcgggcattatatcgccacgccgaaatcggtcagcaaattcccgggcagttatatgctgccgttgcggaagtgttggcctgggtctggcagcttaaacgctggcggcttgcgggcgggcaacgtcctccacaacctgagaaccttccggtgccagaagcgctggattttatgaacgagaagaatactgatggctaatctggtcgcgatgctgcgcctgcccagcaacctgaaatcgacgcaatggcaaattcttgccgggccgatcctcattctgctgattttgtcgatgatggtgctgccgctacctgcttttatcctcgacttattgtttacctttaatattgcgctatcgatcatggtgctgctggtggcgatgtttacccagcgtactctggattttgccgcgtttccgaccatcctgctgtttaccacgctactgcgtctggcgcttaacgttgcctcaacgcgcattattttgatggaagggcataccggcgcggcggcggcgggaaaggtggtagaggcgttcggtcatttcctggtcggcggtaacttcgcgatcgggattgtggtttttatcatcctcgtcattatcaacttcatggtcatcaccaaaggtgccggacgtattgccgaagtcggcgcgcgctttgtgctggatggtatgcccggtaagcaaatggcgattgacgccgatcttaatgccggtctgattggtgaagacgaggccaaaaaacggcgttcggaagtcactcaggaagccgacttctacggttcgatggacggggcaagtaaatttgtacgcggcgacgccatcgccggtattctcatcatggtcattaacgtggtaggcgggctgctggtcggcgtattacagcacggaatgagcatgggcagcgcggcggaaagctacaccctgctgaccattggcgacggcctggtcgcccagatcccggcgctggttatctccacggcggcgggcgtcattgtgacccgcgtcagtaccgatcaggatgtaggcgagcagatggttggccaactgttcagtaatccaagggtaatgctgctggcggcggcggtgctggggctgcttggcatggtgcctggaatgcctaacctggtatttttactctttaccgccgctttgctcggcctggcatggtggctgcgcgggcgtgaagaaaaagcgccggaggagccgcagccggtaaaaatgccggaaaataactcggtggtcgaagccacctggaatgacgtacagcttgaggattcactgggaatggaagtgggctaccgcctgatcccgatggtggattttcaacaggatggcgaattgctcggacgtattcgcagtattcgtaaaaaattcgcgcaggatatggggttcctgccgccggtggtccacattcgcgacaatatggatttacagcctgcgcgctaccgtattttgatgaaaggggtagagatcggcagcggggacgcctatccgggacgctggctggctattaaccccggcacggcggcgggaacgctaccgggcgagaaaaccgtcgatccagcttttggccttgatgccatctggattgaaagcgccctgaaagagcaggcgcaaattcagggctttaccgtcgtggaagccagtaccgttgtggcgacgcaccttaaccacttgattggccaattctccgccgaactgtttggccgccaggaagcgcagcaactgttggatcgtgtctctcaggagatgcctaaactcacggaagatctggtccccggcgtcgtgaccctcacgactttacacaaagtcctgcaaaacttactggcggaaaaagtccctattcgcgatatgcgcaccattctggaaacgctggcggaacatgcgccgttacaaagcgatccgcatgaattaaccgccgtggtacgcgtggcattagggcgagcgattacgcaacagtggttccccggtaatgaagaagtgcaggtgattggcctggataccgcgctggagcgtttgctgcttcaggcattgcagggcggcggtggacttgagcctgggttggcggatcgcctgctggcgcagacccaagaggcactttctcgccaggaaatgcttggcgcgccgccggtattactggttaaccatgcgctacgtccattattgtcccgctttttgcggcgcagtttaccgcagctggtggtgttgtcgaaccttgagctttccgataaccgtcatatccgcatgacggcgaccattggaggaaaataatgcgtaaatggctggcattgttgctctttcccctaacggttcaggccgcaggcgaaggcgcgtggcaggatagcggtatgggcgtaaccttaaattaccggggcgtttccgcatcgtcttcgccattgtcggcgcgccagccggtttccggtgtgatgacgctggtcgcctggcgttatgaactgaatggcccgacccccgcaggattacgggtacgtttatgttcccagtcccgttgcgtagaacttgatggtcagagtggcacgacccacggttttgctcatgttcccgcagtcgagccgctccgctttgtctgggaagtccccggcggcggcagacttatcccggcgttaaaagtgcggagcaatcaggtgattgtgaactaccgctaaccgcccctttctttgccaggtagcagacctgactctctttttgaataaatagaaacgtcgttttataaaatggtgaggtaggttgccggactctttgcgtttttgccatttacgctctgacaatggcagaaacaaaaaggtttccgcccagcttagcttttactgtagcgaatcgactgcgtcggcggtaaaactgcacgcagcactgaattcgacattacacagaggttaagcaaatgatggtttatccagtcaaacacagtccgctattgcgtcagcctgagcattttatcgccagagatgaactaaaagccctggtgcaaaaggtgacgcataacctggtcaatattaaagatgagacaggcgaatttttattgcgactggacgacggacgcgtgatcgatactaaaggctgggccggatgggagtggacgcacggcgtgggcctgtacggaatgtatcactattaccaacagaccggcgaccagacgatgcgtaagatcattgatgactggtttgccgatcgctttgcggaaggcgcgacgacgaaaaacgttaatacgatggcgccgtttttaacgctggcgtatcgctatgaagagacgcgtaatccagcgtatttaccgtggctggaaacgtgggccgaatgggcgatgaatgaaatgccccgtaccgattacggcggaatgcagcacatcacgctggcggaggaaaatcatcagcagatgtgggacgacacgctaatgatgacggtgctgccgctggcgaaaatcggtaagctgttgaaccggccggaatatgtggaagaggcaacctatcagttcctgctacacgtgcagaatttgatggataaagagacggggctgtggttccacggctggagctatgacggtcatcataacttcgctaacgctcgctgggcgcgcggcaacagctggctgaccattgtggtcccggattttcttgaactgctggacttgccggaaaataatgccgtgcgccgttatctggtccaggtactgaatgcgcagatcgccgcgctggcgaaatgtcaggatgaaagcggtttgtggcatacgctgcttgacgatccgcactcttatcttgaggcgtcggcgacggcgggttttgcctacggtattcttaaagcggtgcgcaaacgctatgtcgaacggcactatgcgcaggtggcggaaaaagctattcgggggatagtgaaacatatctcgccggaaggcgaactgctgcaaacatcatttggcactggcatgggccacgatctcgatttttaccgtcatattccgttgacctctatgccttacgggcaggcgatggcaatgctgtgtttgacggaatatctgcgtaactatttctgatgtatgcagatattccggtcgtatccttgtctgatggcgctttgcttatttgactatggcgcctgacccgactgtgtggtatcagcctgtggatcaaacaggtggtcaaggatttttcgcatgatgggcgcggcggtaacgccgtcgcttccgccgttttccagaatcaaggcaatagcgaccttagggtttttatacggtgcaaaagcggtataaaacacatgatcgcgcaggcgaatggggatcattttcgcattgtaggtctgattttctttcaggctaaacacctgcgacgtgccgcttttggccgcaatgccgtagggcgcggtgtgaaagaacttatagcccgttccgttgggtgcattcgccatgccgtacatcgcctgacgcaccagtccccagtatggcgacgccggatcggctatctgtgccggtgttcctgaaggacgatacggaaccaccgttttgccgctctcttcattgagtaacaggtgaggggcaatcaccttactgttgttgatgagcgccaccatcgcttttaccatctggatgggggtggcaatccagtagccctggccgatgccgacagagatggtatcgccctgataccaggcttttttatggacccgctgtttccatgcgcggctgggaagcagcccgtcatactcttcactaaggtcgatacccgtcggtttgccatagccgaactgagacaacatcgtgtcgatacggtcaatacccatcatataagcgacctaatagaaaaaggtatccgcagattcctcaatcgctttagtgacatccagcataccgtgtccggtttttttccagtcccggtaatgacgctgcgtgccgggaagcgtccaggttggcgcgccaaagaaggtggtttgcggcgtaataatcccgcataacagcgcggacatcgccatatagggtttaaccgttgacgccgggggataaagcccttgcgtcacgcggttgatcagcggcagatttttatcgtgcagcagtttgccgtaatcctgatagctaatgccttttacaaaggggttcgggtcgtagctgggcatagataccatcgctagcactgaaccatcgtgcggatcttcaaccagtacggcagcacgctgcccggccagcaaactttcaatgtactcttgtaaatggagatccaacgtcaggtgaatgttcttacccgcgatgggaggaacgtctttcagcaggcggacaatacgcccgtgattatccacctcgacctcctgataaccggttttgccatgaagatcgttttcgtagtaacgctcaatcccctgtttaccgatgttatggtccgccgcgtaattctctgccagcccttttttatccagcgctttaaggtcgttatcgtttatctttgacacgtaaccgagaacatgcgccagctccgcgccgtaaggatactgccgatcctgatagctattgatcgtgacgccgttgaaatgaaactgattgaccgcaaagcgtgcgatttcaacatccgttagcgcgtttttgagcactaccggacgatagcggctactggattttagcgcgcggcgaaagtcggcgatatcgtcgggggagagatcaacaataggggtgagctgttttagcagcgcatccatatcggcaattttatagggcgtaaccgcgatatcataccaggttacgttacgcaccagcggaatgccgttgcgatcgtaaatgatgccgcgcgtgggcgcgacgggtagcatcttgatatcgttctcattcgaacgggtggtgtagtagtggtgctggcggatttgcaagttatagaggttgaagatcaggataccaaagcagacaaccactacaccaaacgccacaatcacacgtctcaggaagagtttctcttccgcatcaaagtctttaaaagtcattacctgtacctgaacaatccgccgcctaatgatacggggcggtcagcgccagcacaggtaaaagatgttccatctctctatagaaatgtgtcattccttgtgatttgttacagatataccgctgtggcaataaaaaggcctgagtccgttacccggagtcaggcctgatgatgttaacgacggcgcgtttacatgcgttctacggtttcgatacccaacgtatccagacccagtttcagcgtcttcgccgtcagttgcgccagttttaggcggctattgcgaaccgcgtcattctcggcgctgagaatagggcagtgctcgtagaagccggagaacagcccggcgacgtcatacagatacgcgcacatgacgtgcggcgtaccttcacgcgcgaccaccgtcagggtttcttcaaactgcagcagacgggcagcgagctgcgcttcgcgatcttcgctaatgataaccggcgcgctcgccagcgcctgctcgtcgatgtccgctttacggaaaacagacagcacacgcgtataggcatactgcatataaggtgcggtattgccttcgaaagccaacatattatcccagtcgaagatatagtcagtggtgcggttttttgacagatcggcgtatttcaccgcgccaataccgacggcgttagccagtttttccagctcgtcagccggcatatccgggttcttctccgccaccagacgacgcgcgcgctccagcgcctcatccagcaggtccgccagtttcaccgtaccgcccgtgcgagttttaaacggtttaccgtctttacccaacatcatgccgaacatgtggtgttccagcggaacggaatccggcacataaccggctttacgcacaatggtccaggcctgcatcaggtgctggtgctgacgggagtcaatgtagtagagcacgcggtcggcgtgcagcgtttcgtaacggtatttggcgcaggcgatatcggtagtggtatacagataaccgccatctttcttctgaataatgacgcccatcgggtcgccttccttgtttttaaactcatcaaggaaaaccaccgttgcgccttcgctttcaaccgccaggcctttggctttcagatcggcgacgatgcccggcagcatcggattatacagactttcgcccatcacatcgtcacgcgtcagagtgacgttcagacgatcataggtgatctggttttgcgtcatcgtgatatcaaccagcttacgccacatctcacggaaataggtatcaccgctctgcaatttgacgacgtagttacgcgcgcgctcggcaaacgtttcatcttcgtcataatgttttttcgcatcgcggtaaaatccttcgagatccgccagcgccatgtcgcccgcgttttcctgctgctgtttttccagccaagcgataagcataccgaactgggtgccccagtcgccgacgtggttagcgcgaataacatgatggcccagaaactccagcgtgcgcactgccgcatcgccaatgatcgtggagcgtagatgaccaacgtgcatctctttcgcgacgttgggcgcggagtagtcgacgacaatcgtctggcgagtcggctgagaaacgcccagacgatcggaggtcagcgcctgttgcacctgttcagcgagaaaagccggttcgaggaaaatattgataaagccagggccggcgatttcaaccttgctggcgatgccgctgagatccagatgagtcagcacctgctctgcaagttgtcggggggccatacccagttttttcgcaactgccatcatgccgttggcctgatagtcgccgaactgaactttggctgactgacgaacctggggctcgcaatctgcaggcgcgcctgcagcaatcatggcctgactaactttttctgagagaagagcctgaatattcaccggaataccttacgtttatgaagcggactgtattgcccgcgccagtttaagaattagggcgggagtatactgcaaatgcccgttggcgtcagcattgcgcgcgcggcgcgtcgcctgaaatatacgcaacaataatctgcataagcattcaataaacgcccaatcaaatcaaaggttggttgccggggcgcaacagcgtaaattagcggttttcacagcaagaagagcgtcctgatatggcgaactggcaacacattgatgaactgcatgatatttccgcagatttaccgcgattcactctggcgttcagagaactttccactcgccttggtctgcagattaacgcccttgaggccgatcacatttcattgcgctgtcaccagaatacgacggcggagcgttggcgtcgcggttttgaacaatgcggcgagctactgtcggaaaatatcatcaacggcaggccgatttgtctgtttaaactgcatgaaccggtatgtgtggaacactggcggttttctgttattgaattaccgtggccgggagaaaaacgctatccacacgaagggtgggagcatattgaaatcgtgctgcccggcgagccggagaccttgaacgcgagggccctggcgttgttgtcggatgaggggcttagtcagccggggatcgtggttaaaaccagttcgccacagggcgagcatgaacgtttgccaaaccctacgctggctgtgaccgatggccgcgtcacggtaaaatttcatccatggtcgattgaagcgattgtcgccagcgaacaggcggcccattaacctgccgagcggagtgaatatggcgttacttgagatctgttgttacagcatggaatgcgcgctcaccgcgcagcgaaacggcgcggatcgtatcgaactgtgcgccgcgccgaaagaaggggggcttacgccttctttcggcatcttacgcagcgtacgcgagcatattacgattcccgtacatccgattattcgtcctcgcggcggagatttttactacactgacggcgaatttgccgccatgctggaagatatccgtctcgtcagagagttggggtttcccgggctggttactggcgtgttgaccgttgatggggatgtcgatatgtcgcgaatggaaaaaataatggcggcggccgggccgctggcggtgacattccaccgcgccttcgatatgtgcgctaatcccttcaatgcgctaaagaatctggctgacgcaggcgtagcaagagtactgacttccgggcaaaaagccgatgcggcgcaaggtttatcaataattatggaacttattgcccagggggatgctccaatcattatggctggtgcgggggttcgtgcaaataacctgcagaatttcctcgatgccggagtacgggaagtacacagttccgccggagtcttactgccttcgccgatgcgctatcgcaatcaggggttatcgatgtctgccgatatacaggcggacgagtattctcgctatagggtagagggtgcggcggtcgctgagaatgaaaggaatcattgttcgccatcaggccaaatgatttttaccgttgcatcatgtcgcccaatatgatgcttgctcgtaccaggcccctgccaattcaacaggggcctttttttctccttcatatttcaagccgcagcagcgttggccgcctcgcgcaccccggtcacgtagctacctacgttcccggggatttgctgcgttgccgccttgctgcaacttgaactattttggagaaacggtgctatacgtaacggtcattcggcaatccatcacggtttacgcgcaatcagcaccgcgcgctgcggggcgggatagccttccaccgtcttgctgcgatcgttcgggtcaagaaaatcggccagcgactcggtaaccatccattcggtacggcgctgctcttcggtggtagtgacgcaaacgtcagcgatacgcacatcaacaaagccgcatttttccagccatttttttaatgccggcgcggaaggaataaaatagacgttacgcatctgcgcgtagcggtcacccggcaccagtacggtattttcgtcgccgtcgacgaccagcgtttccagtaccagctcaccctcgttgaccaactgatcttttaattgccacagatgctccagcggcgagcgacggtgataaagcacccccattgaaaagacggtatcaaatgctttcagcgccgggagttgttcaatgcccaacggcagcagatgcgcgcgctgatcgttacccaacagtttacgcaccgcctcaaattggcagaggaaaagctgtgtaggatcgatgccgaccgccagatgtgcgcccgcgccaatcatccgccacaggtgatagccgctgccgcagccgacatcaaggatcgtccggccggttaaatctgacagatgcggcagtacgcgatcccacttccagtctgagcgccattcggtatcaatatctacgccataaagcgagaacgggcctttacgccacggcatcagattacgcagcaatgtatcaatacgctttagctgaccttcgctgagcggcgtttcgctttccgccgtgacgctgtgcagtaaatccagccgccagggcgtaatttccggtaaaaattctaccgcgttcgaccactgtttaaacaagccatgctgctgctcgcgttgccaggcggcaatctgcgcgggcaatgtttccagccagtgggagagatgatttttagcaatgagctgataaaagttaccaaactcgatcatgcggcaactccggcttttaacgcgacaagcgacccgaagttaaagcactggaaccacagttcgctgtgttcgaaacccgcctgacgcaggcgcgctttatgtgtttccaccgagtcggtgagcatcacgttttccagcatactgcgcttttggctgatctccagttcgctgtacccattagcgcgtttaaaatcgtggtgcatgttgaataacagctcgcccactttcgcgtcttcaaagctaaatttttccgacagtaccagcgcgccgccgggattcaaccccaggtaaatcttatccagcaatgcctggcgttcggcaggttcaaggaattgtagggtaaaattcagcaccaccatcgaggcgttttcaatagtgatatcgcggatatcgccttcaacgacttcaaccggcgtaggcgctttatacgcatcaatatgacggcggcagcgttcaatcatggccggggagttatcgacggcgataatgcgacaatgctcatggcggatattacgccgaacagacagcgtcgcggcacccagcgagcagcccagatcgtagacctgcgtgttcggctgcacaaagcgttcagctaacatgccgatcatggagatgatgttggagtagcctggtaccgaacgctgaatcatgtcggggaaaacttcggctactcgttcatcaaaagtccagtcgccgagacgggcgataggcgcagaaaaaagcgtgtcgcggtgagacataacgtatacatccgggaaaaataaaggcgcatattgtgcgctaatacagggagaaaaccaactcccagggcatataccacaggtttgccagcaccatcagcaacaatgcgcaccaggtcgcgctcatccccgcccgccgccagcggaacaggcggtggtgaaaaccgtaataatgcatcagccgaccggcgattaaaatgatgccgcagatatgcaccatccacgtttcggcgccgttcatttccataaacagcagcagcaccagcgcgacaggaatatattccaccgcgttgccatgaatacggatggcgctttgcaattcgctaaaaccgccgtcgccataggcgacacggtactgcattcgtaagcgaacgacattaaaagagaacttcattaataataacgcacccaaaacggcatacagcgcgcttaccatacaaactcccttttaaaatggctgatggcactgtctatgatagggggcattttcagaaaagagaagattgctgtggaatggacggagcagtgccgatttccggtaagacgctgcgtaaatcatgccaaagcgtattcaccagttccggcgcctgcgcgatatccggagtatgtaaaaacagaaaaggcgtggtggtctgccgccactgcgggagtttctgcaaccaggcagcgaaaaactcacggttttgcgccatattatcgctaccgataaaacgcaccatcggatggctggccgtcacgaccgcatgtaccgggactttgggtttttttcgctgcgcgtcacggacggcctcgctgtggggatgggcggcatgtaccggacgactatccaggatcacgcggtttacgccgcgcgcgtgtaacccgcgattgagccgctgttcatcctcacccttgtcaaaaaaacacggatgacgaacttctacgccataggtaaacgtggcggggagcgcatcaagaaactgccataaggcggggagatcgcgcggtccaaaggcggcgggcaactgcagccagtattggccaatacgcgtttccagcggcgccaggcgggtaaaaaacgcctgtaccagatcgtcgcaatggcgcagagcggcctggtgagaaatggtggcgggaaatttaaagcaaaaacggaaatcgtccgtagtttgcgcataccagcgatcgacaatttccgctttcggcagcgcgtaaagcgtggtgttgccctccacgcagttaaagtggcgggcatactcttccagactggtgatgccgagccgcgcccatttcgggtgcgaccattgcggcaagccaatgtagatcataaggcgtttaaaatatcctctacgctgcgtacccggccaatgcgcgggaaaatatgcgtcatactgctctgatgctgctcactgctggcggcgctacaggcatcttcggcaataataaggttaaatcccaactcccaggcgttacgcgctgtggattcgacgccgatattggttgagattccgcacaatatgatggtgtcgataccccggcggcgaagctgtaattccaggtcggtgccgtaaaacgcgccccactggcgtttagtcacttccagatcgctgtcctttttacccaatgccgtaggccaggtccaccagttttccggcaacgcgtgcgcaggcgttgcggcatccaccggctgttttaacgcttcggcataatcatcagaccatccaacgcgtaccataaccacgggcgagccgttggcgcgacacttttccgccagccgcgcggcgcgggcgaccacctcatttgccgtatacgggccgccggcaaacggaagaattccttcctgtaaatcaataaccaccagggcggttgtggtcgcgttgagtttcagcatgataatcactctcctaaaaatagcggatttcactacaccttaagcgcgattaaagaggaaagcggcgacaaatattgttaatttttgtgagcatacgcaatacccgcgtgaaaaacccgggtacagtcagtatgaaccaagtgtcgataccgcatgaaacgggcaagttatcgctcccatgctggattgactcttatcgtgcggcagaatttccagtataatagccgccttttttcatccagttgtgacatacagctaaagctgcgacttcgtcgcctgcatggcaggcaacaatccgcctgcggctaagttaagggatatctcatgcgtacagaatattgcggacagctacgtctgtcccacgtggggcagcaggtgactctgtgtggttgggtcaaccgtcgtcgtgatcttggcagcctgatctttatcgatatgcgcgaccgcgaaggtattgtgcaggtgttcttcgatccggatcgtgcggacgcgttaaagctggcctctgaactgcgtaatgagttctgcattcaggttacgggcaccgtgcgtgcgcgtgacgcgaaaaacgtcaatgcggatatggcgaccggcgaaattgaagtgctggcgtcctctctcactatcatcaaccgcgcagactcactgccgcttgacgctaaccacgttaataccgaagaggcgcgtctcaagtaccgctatctggatttgcgtcgtccggaaatggcgcagcgcctgaaaactcgcgccaaaattaccagcctggtgcgtcgttttatggacgatcacggtttccttgatattgaaaccccgatgctgaccaaagcgaccccggaaggcgcgcgcgattacctggtaccgtcccgcgtacacaaaggtaaattctatgcgttgccgcagtcgccgcagctgttcaaacagctcctgatgatgtccggtttcgaccgttactatcagatagtcaaatgcttccgtgatgaagacttacgtgctgaccgtcagccggagtttactcagatcgacgtcgagacctccttcatgaccgcgccacaggtgcgcgaagtgatggaagcgctggtgcgccatttgtggctggaagtgaaaggcgtggatctgggggatttcccggtcatgacgtttgccgaagcggaacgtcgctacggttccgacaagccagacctgcgtaacccgatggagctggtagatgtcgctgacctgctgaaatcggtagagttcgcggtcttcgcgggcccggctaacgatccgaaaggccgcgtggcagcgctgcgtgtgcctggcggcgcacagcttagccgtaagcagatcgacgattacggtaactttgttaagatctacggcgcgaaaggactggcatatatcaaagttaacgagcgcgcgaaaggtctggacgggattaacagtccggtggccaagttcctgaccgccgacatcgtcgaggctatccttgaacgtaccggcgcgcaggacggcgacatgatcttcttcggcgcagataacaaaaaagtggttgccgatgcgctgggcgcgctgcgtctgaaactgggcaaagacctgagcctgaccgacgaagacaaatgggcgccgctgtgggtgattgacttcccgatgttcgaagacgacggcgaaggcggtctgaccgcgatgcaccatccgttcaccgccccgcgtgacatgacggcgtctgaactgaaaactgccccggaagaagccgtcgctaacgcttacgatatggtgattaacggctatgaagtgggtggcggttcggtgcgtattcacaacggtgaaatgcagcaaaccgtatttggtattctcggtatcaatgagcaggagcagcgcgagaagttcggcttcctgttggatgcgttgaaatacggtacgccgccgcacgtgggcctggcgtttggtctggaccgtctgaccatgctgttgaccggcaccgacaatattcgtgatgttatcgccttcccgaaaacgaccgccgccgcgtgtctgatgactgaagcgccgagtttcgccaaccaggcagcgttgacggagttggggattcaggttgtgaagaaagccgagaataactgatatgaacaatgtacacgacatcattcgcgtgatatcgcggcggcccgcaagggggagtctcatcaatgcgcggcgtcacccaacagccaacaacgaggtcgcgtgaaggataaagtgtacaagcgccccgtttcggtcctggtggttattttcgcgcaggatacgaaacgggtgctaatgttgcagcgacgcgacgacccggatttttggcagtcagtgactggcagcatagaagaaggggagaccgcgttgcagaccgccgtgcgtgaagtcaaagaggaggtcacgattgatgttgcggcagagcaactgaccttagtcgactgccaacgtacggtggagtttgaaattttttcacatttacgtcatcgctatgcgccgggcgtcatgcacaatacagaattctggttctgccttgcgttaccgcatgagcggcaggtgatattcactgaacatctaacgtaccagtggcttgatgcgcctgacgcggcggcgcttaccaagtcctggagtaaccggcaagcgattgaagagtttgtcattaacgtcgcctgaaaaggcgcgctttttttgaggaaatatttatggcaggtcatagtaaatgggccaacaccagacatcgtaaagctgcgcaagatgccaagcgcggtaaaatcttcactaaaattattcgtgaactggtaacggcagctaaattgggcggcggcgatccggatgccaacccgcgtctgcgcgcggctgtagataaagcgctggccaacaacatgacccgcgacactctgaaccgtgccatcgctcgcggtgtgggtggtgatgaagactcgaacatggaaaccatcatctatgaaggttatggtcctggcggcacggccattatgattgagtgtttgagtgacaaccgtaaccgtaccgtagcggaagtgcgtcatgctttcagcaagtgcggcggtaatctgggtaccgatggctcagtggcgtacctgttcagtaagaaaggggtcatctcctttgagaaaggcgatgaagacaccatcatggaagccgcactggaagctggcgcggaagatgttgtgacctatgatgatggcgcgattgatgtttacactgcctgggaagagatgggcaaagtgcgtgacgcgctggaagcggcgggtctgaaagcggacagcgccgaagtgtccatgatcccgtcaaccaaagcggatatggatgcggaaaccgcgccgaaactgctacgtcttatcgatatgctggaagactgtgacgatgttcaggaagtctaccataacggtgagatctctgatgaggtggcggcgaccctgtaatggtgctgctaaacgccggcgggcagggggtatagcgtgtcgattattctcggtattgaccccggctcgcgtattaccggttatggcgttatccgccaggtaggcagacaactgacctatctgggcagcggatgtattcgtaccaaagtcgatgatttgccgtctcgtttgaagctcatatacgcaggcgtgacggaaatcatcacgcagttccagccggactattttgctatcgaacaagtgtttatggcgaagaatgccgattcagccctcaagctgggacaggcgcgcggcgtagcgattgtcgccgcggtcaaccaggaactgcccgtgtttgaatacgcggcgcgtcaggtgaagcaaactgtcgtcggtattggtagcgcggagaaaagccaggtacagcatatggttcgtacgttgctgaagctccccgctaacccgcaggcagacgccgcagatgcgctggctatcgccattacgcattgccatgttagccagaacgcgatgcaaatgagcgagagccgactcaatctggcgcggggaaggttgcgctaaattattctccctcagcctcgcgttgagggttttcaattccacaggcgctaattaattctaaattgggatgttgccacaggctggcgggcgtcaccgtcttacgatcccacgggattgaacctaaaaaccagaatttccagaaggtgagtttcgcatcaggattgctgtgaagtaattcttcgaatgtctcaatatcgcctaccggaatacacaatgcttctttatagatatcaaacacaaatttcgagcagaactggcgcgatgactcgtatttaaaccccgtgtgataaaacttattcagccgggcgggaacctgctccatgatggcgagtttctgctcgaccgtcaggccgccgcacaggcgacgaaccgcgtaacgttgtccggctgaacgttgtataaacagtgacagcgtggtgacggttgagagggggacgcgactttccgccaccagatagtcatcaccattatgaccaataataatcccaacatggttgctccagcactgtgaagcggtggatatctggccgaaaagcgcggcacctatacaggtaaagacgatatccccggtttcatattggacaggataatgttttttcatctctgcattccattatttgaaataaattccttttatttattctacagggtagttagcattataccagataaatgacaagccttagtgtcatcgaaatatgtatggtgaatatttcatttgttggaattaatgtcgcaaatataactggggaggaattaaggtggtaaatttctcattatctgctctcttatattgacagggagtacgacgtggttgatgataaaccaatgaaaataggttgggtgttttatttttcttatatttttgttgctattatctttcatctgtttattagtttttgttattgtttgagtattgatatggcagaggctaataccgttgtttttttattaaagccagggacgatttcattattatttttacttctccctgccaggcggttcagaaccagactgttggcaacattgagttcagttttcattgccttagtatttaaccagtggcatttggttgccgggaataaagaactggttttgtgcatgcaggcagcgtgctttatggctttcctggctatgacatcggtaaaaaaatccgggtggatgattagcgcatcattatttttggtttgtgcggccggaacgattcgccagtgctggctggaacagttgtttaacgctgccgatatatatattgttgatgatgggcggagctgtggtgccagcggccactgcttccagtatattgcagcaaaaggccgtgggttagcagcaaaacgacaggcactttttagtagtgaagagtatgtgaatatttattatagttattcagaagggataccagccgtgaatttcgatggcatgaaaaatgagtttgcacaatatttattgtgtcatggtgaattaaaatatgttgtgcgcgacgataaaacaacatgcgattaaattcagcgctagtggttaattttattaaatctattctcgggtctgttttttggggggaccgatgttccgctgttggcattcgtactggatacagtattagtgttatcaggatactcattattgaagactaccaaacttgcgccacggcatgttggcaaaaagttattcgcgtaggacgcaaaaagttgtcaatgagtgtacgacttattttgtacgcagcggggagcgtgcccgtcgttaactatcgcgggttgtcggagtacagaaatatcgggataagtgtttttcatctggataaacatccagtctttttttatgatagtgcattatcttttcagccctttacgcaggagcgtcatgtgataggcagactcagaggcattattctcgaaaaacaacccccgatcgtgctgctggagacagggggcgtaggctatgaagtacatatgcctatgacctgcttttacgagctgccggaggccgggcaggaggcaatcgtcttcacccacttcgtggtgcgtgaagatgcgcagttgctgtacggatttaacaataagcaagagcgcacgctatttaaagagctaattaaaacgaatggcgtcgggcctaagctggcgctggcgatcctctccggcatgtcggcgcagcagtttgtgaatgcggttgagcgcgaagagctgggtgcgctggtgaagctgccgggtatcggcaagaaaaccgccgaaaggctgattgtcgaaatgaaagaccgctttaaagggctacatggcgatctctttacgccagcggtcgatctggtattgacgtcgccggccagcccaacctcggaagatgcagaacaagaagcagttgctgcgctggtggcgctgggttataaaccgcaagaagccagtcggatggtaagtaagatcgcccgtccggacgcaagcagtgaaacactgattcgcgacgcgttacgcgccgcgctatgaggtaaaggatgatagaagcagatcgcctgatttcagcaggcgccacgatcgcagaagacgtcgccgatcgcgccattcgcccgaagttattggcggaatatgtcggccaaccgcaggtgcgctcccagatggagatctttattcaggcggcaaaacggcgtggcgacgcattagatcacttgctgattttcggcccgccagggttaggtaaaacgactctggcgaatatcgttgccaatgaaatgggcgtcaacctccgaaccacgtccggcccggtgctggaaaaagcaggcgatctggcggctatgctcaccaatcttgaaccgcatgatgtgctgtttattgatgagatccaccggctttcaccggtggtggaagaggtactctatccggcgatggaagattaccagttggatattatgattggcgaagggccggctgcacgttcaattaaaatcgatctgccgccgtttacgctcattggcgcgacgacgcgcgccgggtcgttaacgtccccgctacgtgaccgttttggtattgtgcagcgcctggagttctaccaggtgcccgatctgcagcacatcgtcgggcgcagcgcaaggcacatggggcttgagatgagcgatgacggcgcgctggaagtggcgcgtcgggcgcgcggtacgccgcgtatagccaaccgcctgctcagacgtgtgcgtgattttgctgaggtgaagcatgacggggctatttcagcggaaattgccgcgcaggcgctggatatgctgaacgtcgatgcggaagggtttgattatatggatcgcaagctactgctggcggttattgataaattcttcggtggcccggtgggactggataatctggcggcggcgattggcgaagagcgtgaaaccattgaggatgtgctggagccgtatctgattcagcaaggctttttgcagcgcacgccgcgtgggcgtatggcaacggtgcgcgcctggaaccactttggtattacgccgccagagatgccttaacgcctgaagtcgctgcgctcatcaggcctgggcgattttgtaggcccggtaagcgcagcgccaccgggcaacacacgcttagcttgcctgctttttcatcatactgaagataaacagcagcgcggcacacagcactacggatggccctgccggggtatcataaaaggctgagaaggtcagtccacctgtaaccgctatcatacctacaccaacggcgacgcccgccatctgctccggcgtacgggcaaagcgacgcgcggttgcggcggggataatcagcagcgaggtgataatcagcgctccgacaaacttcatcgttacgccaatggttaacgccgttaccagcatcaatagcagcttcacgcgctgtaacttcacgccatcgacaaaggcaagatccggactgatagtcattgacagcaagttgcgccactgccagaagagaatggccagcacaataacgaccccaatagcgatcgagataagatcttccggcgtcacggccagcaaatcgccaaacagataagccattaaatcaacgcggacgttggacatcaggctgaccacgaccagtcctaaagacaaggcgctgtgtgccataatgcccagtaaggtatcaatcgcgaggtgagggcgtttctccagccataccagaccggaggccagcagcagcgtaacggcgattaccgcataaaaggggttaacgtccagcaacaggccaaacgccacgcccagaagcgacgcgtgagccagcgtatcgccaaaataggacatccgacgccagaccacaaatgagcccaacggaccagcagcgcaggccagcatcatcccggccagccagccgggcagtaataattcaatcatgagtgaccatttccccggcgcagtacaatacgaccctgtaaatcgtggcgatgattatgatgatggcgataaatccctaattgctccgcgccacgcgggccaaacatagagataaattccggatgcatagacaccacttccggcgcgccggaacagcaaatatgatggttcaggcataacacttcatccgtttttgccatgaccagatgtagatcatgcgacaccatcagaacggcgcaatcgagttcacggcgcagctgatcgataaggtcgtataacgcgacctggccgttgacatccacgccttgcgtcggctcatcaagtaccagcaactgcggcctgttaagcagagcacgggccagcagtacgcgctgtgtctcaccgccggagagtttttgcatgggcgcgtcaatcaaatgtccggcctgaacgcgtttaagcgccgggagaatatccgttttttgcgtgcagggacgtaaacgtaaaaatcggtttaccgtcagcggaagcgtggtatcgagatagagcttttgcgggacatagccgatacggagttgcccgttgcgcttgatcaccccttcatcaggggctaccagtcctaaaaccacgcgtacaagcgttgacttccccgcaccgttagggccgagaagcgttaaaatttttccggggctcaattcaagcgacacgtcagagaggacgcggcgttgaccaaatgagaccgagacgttttccagtgaaactaaacttgtcatgttaattttaggcttgcagaagtgatagaatgttataatatcacatttcacatattcattacgatgattagtcgcattatgttacagaaaaatacgcttcttttcgcagcattatccgccgcgctttgggggagtgcaacccaggctgccgacgccgccgttgtcgcttcgcttaaaccgcttgggtttattgcttccgccattgctgatggcgttacggatacgcaagtattacttccggatggggcatccgagcatgattattcattgcgtccatcagacgtaaaacgcttacagggcgcggacttagtcgtctgggttggcccggaaatggaagcctttatggagaagtcggtcaggaatatccctgataataagcaggttaccattgcgcaacttgccgatgtaaaaccgttactcatgaagggcgcggatgatgatgaggatgaacatgcgcatacgggcgccgatgaggaaaaaggtgacgtacatcaccatcacggcgaatataacatgcatctttggctctccccagagatagcgcgggctacagcggttgcaatccatgaaaaattagtggaacttatgccgcaaagtcgagctaaactcgacgccaacctgaaggattttgaggcacaattagccgcaaccgataaacaggtcggtaacgagctcgcgccgctcaaggggaaagggtatttcgtttttcatgacgcctacggttactacgaaaaacactacggactcaccccactcggtcactttaccgtgaaccctgagatacaacctggcgcgcagcgtttacatgaaataagaacacagttggttgagcaaaaagcaacctgcgtttttgctgagccacaattcaggccagcggtcgtggaagccgtggcgagagggacatccgttcgaatgggaacactggaccccctcgggacgaacattaaactgggtaaaacaagctattcagcgtttttaagccaattagccaaccagtatgcgagctgcctgaaaggagattaacgaggaagtgaatacgtgcaacagatagccggctctgtcgccctggcatttaataatctgccccgaccccaccgcgttatgctggggtcacttaccgttctgacactggccgtcgccgtatggcggccctatgtttaccacccagaatccgcaccaatcgttaaaactattgaactggagaaaagcgagattcgttccctcttaccggaggccagcgaacccatcgatcaggccgcgcaggaagatgaagctattcctcaggatgagctggacgataaaaccgcaggcgaagtcggcgtccatgaatacgtcgtctccacaggcgatacgttaagcagtattctgaatcagtacggcatcgatatgagcgatattagccgacttgccgcttctgataaggagctgcgcaatctgaaaattggccaacagctttcctggacactgaccgccgatggcgatttacagcgtctgacatgggaagtctcccgccgtgaaacgcgtacctacgatcgcactgccaacggttttaaaatgagcagtgaaatgcagcagggggactgggtcaacagtctgctgaaaggcacggtagggggcagctttgtcgccagcgcgaaagaggctggtttaaccagcagcgaaatcagcgcagtgataaaagcaatgcagtggcagatggattttcggaagctgaaaaagggcgatgaattttcggttctgatgtcgcgtgagatgctggatggcaagcgtgaacagagtcagttgttgggcgtgcgtatgcgttccgatggtaaagattactacgccattcgcgccgctgacggtaaattctatgaccgtaacggtgttggcctggcgaaaggctttttacgcttcccgaccgccaaacagttccgcatctcctccaacttcaatccgcgtcgtctgaacccggttaccggacgcgttgcgccgcatcgtggcgttgactttgcgatgccgcagggtacgccggtgctgtcggtgggggatggcgaggtcgtggttgctaaacgtagcggcgctgccggttactacattgcgattcgtcatggacgcacctacaccacacgttacatgcacttgcgtaagctgctggtgaaaccggggcaaaaagtgaaacgtggcgatcgtattgcgctttctggtaacaccgggcgttccacagggccgcatctgcattatgaggtatggatcaaccagcaagccgttaaccctctgacagcaaaattgccgcgcacggaaggtctgacggggtcagatcgtcgtgaatacctggcacaggtgaaagagattctgccgcaactgcgcttcgattaacaaatgcgttgacagagccggtacgcgatgtgtgccggctgttttgttttgtgtgcggcgcagacatcgctacactattcacaattccttttcgcgtcagcagaccctggaaaagcatggaaaccaaaaaaaataatagtgagtatatccctgaattcgaaaaatcctttcgctatccgcagtattggggcgcctggttgggcgctgcggcaatggcggggatcgcattaacgccggcatcattccgcgaccctttgctggcgacgctggggcgttttgccggacggctggggaagagttctcgtcgccgggcgctaattaatctgtcattgtgctttccgcagcgtagcgaagctgaacgcgaagcgattgtcgatgagatgttcgccaccgcgccgcaggcaatggcgatgatggctgagctggcgatgcgcggtccgaaaaaaattcaacagcgtgttgactgggaaggtctggagattatcgaggagatgcgtcgtaacgacgaaaaagttatttttctcgtaccgcatggctggggcgtcgacattccagccatgctgatggcctctcaggggcaaaaaatggcggcgatgtttcataatcagggtaatccggtttttgactatatctggaataccgtgcgtcggcgttttggcggacgtttgcatgcgcgcaatgacgggattaaaccctttattcagtctgttcgtcagggctactggggttactacctgccggaccaggatcatggcccggagcatagtgaattcgttgatttctttgcgacatacaaagcaacgctgcctgcaattggtcggctgatgaaagtgtgccgcgcacgcgtgataccgcttttcccggtgtataatggtaaaacgcatcgcctgactatccagattcgtccgccaatggacgatctgctcacggctgacgaccacactatcgccagacggatgaacgaagaggtcgaaatttttgtcggcccgcatccggaacagtacacctggattctgaagttgctcaaaacccgcaagccaggcgagattcagccgtataagcgtaaagatctttatcccatcaaataaataaagcctctcgtaagagaggctttatgctgacaaaccctgtattacctgatgagcaggccagggggagctttactcaacggtcaaaatacgcgtggtattggttgaaccgacggtgctcatgacatcgccctgggtcacgataaccaggtcaccggaaaccagataccctttatcgcgcagcagattaacagcttcatgcgccgcgacaacgccatcagccgcgctatcaaaatgcaccggcgttactccgcggtagagcgcggtcaggttcagcgtgcgttcatggcgcgacatggcgaaaatcggcaggccggagctgatacgggaagtcattagcgcggtacgaccggattccgtcatggtgatgatcgcggtaacgcctttcagatggtttgccgcatacatcgcagacatggcaatggcttcttcaacattgtcgaactgcacgtcgagacggtgtttagacacattgatgctggggattttttctgcgcccagacagacgcgcgccattgcggcaacggtttcagaaggatactgaccggctgcggtttcggcagacagcataactgcatccgtgccatccaggacggcgttcgccacgtccatcacttccgcacgggtcggcatcgggttggtgatcatcgactccatcatctgcgttgcggtgatgactgcgcggtttagctgacgcgcacggcgaatcagcgccttctggataccaaccagctccggatcgccgatttcaacgcccaggttgccacgtgcgaccatcacaacgtcagaggccagaatgatatcgtccatagcgttttgatcgcataccgcttcggcgcgttcgactttagccacaattttcgcgtcacagccggcgtcgcgcgccaggcggcgtgcatagttcagatcttcgccgcagcgcgggaaggagactgccagatagtcaacgcctatcagcgcagcggtttgaatatcggctttatctttttcggtcagcgcttcagcagaaagcccgccgccgagcttgttaatgcctttattgttagacagcgggccgccgacggtgacctcggtaaagactttcatgccctggacttcaagcactttcaactgcactcgaccatcgtcaagcagcaggatatcgccaggaacgacgtctgccggcaaccctttgtaatcaatgccgactttttctttatcgccttcgcctttacccaggttagcgtctaacagaaatttgtccccgatattgaggaacactttgccttctttaaaagtggaaacgcgaatttttggcccttgcaggtcgcctaaaatagccacatgacgccccaatttggcggcaatctcacggactttatcagcacgcattttatgatcttccggcgagccgtgagagaagttcatacgtactacgtttgcgcccgcggcgataaccttctcaaggttgttatcgcggtcagttgccgggcctaacgtggtaacgattttggttctgcgaagccttctggacatgtaatactccgttgactaaaacaacttggtgttgcgtgaacattgatccggtcgttctgaaaccttaacggtataaaatgaacgtccccggatgacgaaaagggtagaacattgttattgcttttagcggtcatcactcctgatgagtaattctttatcaaaacgcgattccttgagcgcttccttgacacgcttcaagttatctctgaattttgccccgcgacgcaaagtaaatcccgttgccagcacatctatcacggtcagttgagcaagtcgagagaccatgggcatataaatgtctgtatcttccggtacgtcgagggtaatggccagcgtggcttcgcgcgccagcggcgttccagcggaggtcagggcgatcaccatcgcatcgttttcccgcgccaactgcgccagttccaccaggctcttggttctgccagtatgcgaaatgagcacgacgacgtcatcatcgttacaattcatacagctcatccgttgcagcacgatatcgtcggagtaaatcaccggcacattgaagcgaaaaaacttattcatggcgtcatgcgcgaccgcggcggaggaaccaagaccaaaaaaggcgattttttttgcctgggtcagtaaatcgacggcgcggttgacggccgatttatccagcgactgacgaacatggtcgagactggccatggcggactcgaagatttttcctgtataggcctcaacgctgtcatcttcatccacattgcgattaacatagggggtgccatttgccagactttgcgccagatgcagtttaaaatcaggaaagccgcgggtattcatgctgcgacagaaacggttcaccgttggctcgctaacgttagcttcctgggccagcatggcaatgcttaagtgaatcgatctgcctggggcggccagaataacatcggcgacttttcgttcagatttgcttaaatgttccagttgagactggactttttccagcatattcatgattagcaaggctcatgggtattagcgatttcaatgatgcgcgaaaccgagcgcgttttgttagatattactcctggcggctgtcaaagggggcaaaatggctaaaaaaggtgtcgttttttttcattacatgaccgacgtcggattttaagttccagcttgtgtggaaaagcgacaattttattaggcgttttgccgattatattgccaatcaaacgccggttcacctatgaaaaggcgtttacggtttccgtaatctcgtaaaagcagtacagtgctgtgtaataaaattacaacgatatcctggctaaagtaccaggagattaactgaggagaatgacatggcggtaacgcaaacagcccaggcatgtgacctggtcattttcggcgcgaaaggcgacctggcgcgccggaaactgctgccttccctgtatcagcttgagaaagccggccagatccatccggatacccggatcattggggtggggcgcgcggactgggataaagaagcttatacccacgttgtgcgtgaggcgctggaaaccttcatgaaggaaaaaattgatgaaggcttgtgggatacgctgagcggccgtctggatttttgtaatcttgacgttaacgatacgcctgcgttcagtcgcctgggcgatatgctggatcaaaaaaaccgcaccaccattaactattttgcgatgccgcccagcacgtttggcgctatttgcaaagggttaggggaggctaaactcaacgccaaaccggcgcgtgtcgtgatggagaaaccgttgggtacttcgctggcgacctcgcgtgagattaacgatcgggtcggcgaatactttgaagagtgccaagtatatcgtatcgaccactatctgggcaaagaaacggttctcaacctgctggcgctgcgttttgccaactcgttattcgttaataactgggataaccgcactatcgatcacgttgagattaccgtagcggaagaggtggggattgaagggcgctggggatattttgaccaggccggtcagatgcgcgatatgatccagaaccacttgctgcaaattctctgcatgattgccatgtcaccgccgtctgacctgagcgccgacagtattcgcgatgaaaaagtaaaagtgttgaaatcgttgcgccgtattgatcgctccaacgtgcgtgaaaaaacggttcgtggtcaatacaccgcgggctttgcgcagggtcaaaaggtgccgggctatctggaagaagagggcgcgaataaaagcagcaacaccgaaactttcgtcgcgatccgcgtcgacatcgataactggcgttgggcgggcgtgccattctatctgcgcaccggcaagcgtctgccaactaagtgctctgaagtcgtggtttatttcaagacgcctgaactgaatctctttaaagagtcctggcaagacctgccgcagaacaaattgacgattcgcctgcagccggatgaaggcgtagatattcaggtacttaacaaagtaccgaggctggatcataagcataatctgcaaatcacgaagcttgatctgagctactccgagacctttaatcagacgcacctggcggatgcatatgagcgcctgctgctggaaacgatgcgtggcattcaggcgctgtttgtccgccgtgacgaagtggaagaagcctggaagtgggtggactccattaccgaagcatgggcgatggacaacgacgcgccgaagccgtatcaggcgggcacctggggaccggtagcgtccgtggcgatgattacccgtgacggtcgttcgtggaatgagtttgagtaaatttgccactcactcttaggtggtattttaccggtaacatgatctaacacagattgtagaatcatttttgcacttttaagcctcgtgtggattcacctgcgaggctttttttattacactgcctgaaacgattttgccccattatccccggacatcatgtatttcactgtctttccacattgatgaaacgcatggtaaacccggtagccggacagataaatttcaggagcctctatgaatcctaatttgttacgcgtaacacagcgcattgtcgaacgctcgcagcagacccgaaaagcctatcttgcccgcattgagcaggcgaaaaccgccacggtccaccgatctcaactggcctgcggcaacctggcgcatggcttcgccgcctgtcagccagaggacaaagcctcgctgaaaagtatgttgcgcaataatatcgccatcattacctcctacaatgacatgctctctgcgcatcaaccgtatgaacattatccgcagattattcgtcaggccctgcattccgtgaatgcggtaggtcaggtcgcaggcggcgtaccggcaatgtgcgatggcgttacgcaagggcaggatggcatggagttgtcattactcagccgcgaagtgatagcgatgtcggcagcagtaggcctttctcacaatatgtttgacggcgcgttattcctcggcgtatgcgacaaaattgttccggggctggcgatggccgcgctctcttttggtcatttacccgcgatttttgttccgtcaggcccgatggcgagcggcctgccgaataaagaaaaagtccgtattcgtcagctatatgcggaaggaaaagtagacagaatggcgctgctggagtcggaagccgcctcttaccatgcgccgggcacctgtacattttacggcactgccaacaccaaccagatggtggtggagtttatgggaatgcagttgccgggttcctcgtttgtgcatccggatgcgccgctgcgcgaggcattgactgccgctgccgcacgtcaggtaacacgtcttaccggcaacggcaatacgtggatgccgctcggtaaaatgatcgacgaaaaagtcgtggtgaacggcattgtcgcgctgctggctaccggcggttccaccaaccacaccatgcatctggttgcaatggcgcgcgcggcgggcattctgatcaactgggatgacttctcggatttgtcggaagtggttccgttgatggcgcgtctgtacccgaacggtccggcggacattaaccacttccaggcggcgggcggcgtaccggtattgatgcgtgagctgctcaatgccggattgctgcacgaagacgttaatactgtcgcaggcttcggcctgaaacgctatacgctggagccctggctcaacaacggcgagctggactggcgtgaaggcgcggaaaggtcactggataacgatgtcattgcctcttttgataagccgttctctcctcacggcggtactaaggtgctaagcggtaatctggggcgcgcagtaatgaagacgtctgcggtaccggttgaaaaccagatcattgaagcgcctgccatggtatttgaaagtcagcatgatgtgctgcctgcgtttgacgcgggcctgcttgaccgggattgtgtcgttgtcgtgcgtcatcagggaccaaaagcgaatggaatgccagaattacataaactcatgccgccacttggtgtattattggaccgccgtttcaaaatcgcgttagttactgatggacgactttcaggcgcttcgggtaaagtgccttcagctatccacgtaacgccggaagcctacgatggcggcttactggcaaaagtgcgcgatggcgacatcattcgcgtgaatgggcagacaggtgagttaactctgctggtcgacgaggcggaacttgccgctcgtcagcctcatattccggacctgagcgcgtcgcgcgtcggaacggggcgtgagttgtttggcgcgctgcgcgaaaagctgtcgggtgcggagcagggcgcaacctgtatcactttttaagatgacacactagtaatcaggcgagagaagaattccgatgaaaaactggaaaacaagtgcagaagcaatcctgaccaccggcccggttgtcccggtcattgtagtcaataaactggagcacgcggtgccgatggctaaagcgctggtggccgggggcgttcgcgttctggaagtgactttacgtacggcctgcgcgatggatgctattcgcgctatcgctaaagacgtgccggaagcgattgtcggcgccggaaccgttctcaatccgcagcagttggcggaggtgacggaggcgggcgcgcagtttgcgattagcccgggactgactgagccactgctgaaagccgcgacggcaggcactatcccattgattcccggtattagcaccgtttctgaactgatgttgggcatggactatggtctgaaagagttcaaattcttcccggcggaagcgaatggcggcactaaagcgttgcaggcgattgccggtccgttctctcaggtacgtttctgcccaaccggcggcatctctctggcaaactatcgtgactatctggcgctgaaaagcgtgttgtgcatcggcggttcctggctggtgccggccgacgcgctggaagcgggtgattacgatcgcatcaccaaactggcgcgcgaagcggtagaaggcgcgaagcagtaagccgttaaatgcccgatggcgcttgcttatcgggcttacgagtggcgatcaggcaggcctgataaaaatgtgctaacgtcgccatcaggcgatggcgcattagccttttaccgtcacgcggctggcggcctttttcgctcttatcaccgcttcttcaacgttttcacctgtcgctaacgctacaccaagacgacgggtgccgtcgatctcaggcttaccaaacagccgtacctgcactccggcccctaccgccgcgtgtacatcatcaaacgtcacattttgactggtaagctgcggcagaatcacggccgaggcagcgggaccatactggcgaatagcgcctatgggcattcccagaaaggcgcgcacatgcagcgcaaactcagaaagatcctgagaaatcaacgtgaccattccggtatcgtgcgggcgaggggagacttcgctgaaaatgacttcatcgccacagacgaagagttcaacgccgaacagaccatgaccgcctaacgccagtaccacatgacgagcaatctcttgcgcccgcttcagcgccagttcgctcatctgctgtggttgccaggattcgcgatagtcaccatcttgctgacgatgaccgaccggcgcgcagaaatgcacgccatcgacggcgctaacggtgagcagcgtaatttcaaaatcaaatttaaccacgccttccacaatcacgcgacccgcgccagcgcgtccgccctgttgagcatactcccatgcctgcgcgagctgttcggccgagcggataaagctctggcctttgccggaagagctcatgaccggtttgacgatgcaaggaaaacccactgcggctaccgcatcatgaaaactggcctcactgtcggcaaagcgatacgtcgatgtcggcagacctaattcttctgcggccaggcgacggatcccttcgcggttcatcgtgagctgcgttgcacgggcgcaaggcacgacattcagcccttcgccctccagctcgcgcagcgtatcggtggcgatcgcttctatttccggcacgatataatgcggtttttcctctgtaatcacatgacgtagcgcctcgccgtccagcatattaatgacgtgtgaacggtgagccacatgcatggcgggagcatcaggatagcgatcgacggcgataacctcgatccccaggcgttggcattcaatcgccacctcttttcccaattcacctgcccctaataacatcacccgcgttgctgccggacgtagcgcagtgcctaatagcgtcatatttctgtccccttatttacctgcgcgcagtatatacgaaaacgtttgcgtatgtcttttcgaataaattgcttttcttgccgccttgcaatatactgtatataaacacaggtaaataaggggctgcaaaatggcggttgaagttaaatacgtagtcattcgcgagggtgaggagaagatgtcatttaccagtaaaaaggaagccgacgcctgggacaaaatgctcgatactgccgatcttcttgatacctggcttgagcagtcgccagtcgtgctggaagatgggcagcgcgaggcgttgtcgctgtggatggcggaacataaagaggtgttaagcacgatcctcaaaaccggtaagttgccttctccgcaggcggttgaaaaggacgccgcgagtaaaacgaaaaagcaagccgcctgaacccacacttgcgctctcggcgttttgtaccatgcttttcctgaatcattgtgctaaggagaaaagtatgaataaaagaggagcgttgttgagcctgctgttgttatccgccagcgtatcggcatttgcggcatccaccgagagtaaatcggttaagtttccgcagtgcgaagggctggatgccgccgggattgcggcaagcgtgaagcgcgactaccagcaaaatcgtatcgtgcggtgggcagacgaccaaaaaaaggtcgggcaggctgacccggtcgcgtgggttaatgtgcaggacgttgtgggtcaaaatgataaatggaccgttccgctaaccgttcgcggtaaaagcgccgatatccattatcaggtcatcgttgattgcaaagccggcaaggcggaatataagccccgctagcagcgtaatttgcgcttcttttgccggaacagacaattcctgacatcccctcaggtacgcttgaccattattggtctgtatttgaggggtactatggctaactggttgaaccaattacaatcacttcttgggcaaaaaggcgcttctgcatcgccttccggtgaacaggggttaaataaactgctggttcccggcgcgctgggcggtctggctggactgttggtcgccaataagtcttcgcgcaaattattaaccaaatacggtactggcgctttgctggtgggcggcggcgcggtggcgagttccgtattgtggaataagtacaaagataaagtacgcgctgcgcatcagggggagccgcaattcggcagccaaagtacgccgctggatattcgcactgagcgactgatcctagcgctggtttttgctgcaaaaagcgatgggcatattgatgccaaagaacgcgcggcgattgagcaccaactgcgagaatcaggtgtggaagagcaagggcgtgtgtttatcgagaaagctattgagcagccgcttgatccacaacgtctggcacagggcgttcgcaatgaagaagaagccctggaaatctacttcctgagctgcgccgccattgatattgaccactttatggaacgtagctatctgaatgcgttaggagacgcgctaaaaattcctcaggaggttcgggacggtatcgagcaggacttgcagcagcaaaaacaggcgctaccaggctgataacctgccattaagtaacatgtttcgcttgcatcatgcgtgtcttttgccacccttataggatggatagtttacgtcattcatgttgcaagatagcggcgaagcagtgacatctcaggcgcttaccgaggtgagcggaccgggactaccatgctaagccgctgtgtttgccgcgtgatatataacaaatattaacgcaaaagaaaaaacgacatgttgccaaaagccaatcgaattccctatgccatgaccgtacatggcgatacgcgcattgataattattactggctgcgagatgacactcgctcgcagccggaagtccttgattacctgcatcaggaaaatgagtatggccggaaggtcatgtcctctcagcaggcgttacaggaccgcattctaaaagaaattatcgatcgcatcccgcccagagaagtttccgctccgtatgtgaaaaacggctatcgctaccgttatatctatgaacccggctgcgaatatgccatctatcaacgacaatcggcgttaagcgaagagtggaatgtgtgggaaaccttgctcgatgcgaaccagcgggccgcgcacagcgaattttatacgctcggcgggcttgccattacgccggataataccatcatggcgctggcagaagattatttatcccgtcgtcagtatgggttgcgttttcgtaacctcgaaagcggtaactggtatccggaactgctggataacgttgcgcctgaatttgtctgggccaatgattccctgactctttactatgtgcgtaagcataagaagacgctgctgccctatcaggtttggcggcacacgattggcactccgtcatcgcaagatgaactggtatatgaggagaaagacgataccttttatgtcagcctgcataaaaccacttcgcagcattatgtggtgattcatcttgccagcgccaccactagcgaagtgctattacttgacgcggaactggccgatgccgagccgttttcattcttaccgcgccgcaaagaccatgaatatagtctcgatcactatcaacataagttttacctgcgctctaaccggaacggtaaaaactttgggttgtaccgtacccgcgtgcgcaatgaaaacgcctgggaagagctgatccctccgcgcgagcatattatgctggaagggtttaccctgtttaccgactggttagtggtcgaagagcgtcaacgggggcttaccagcctgcggcaaattaaccgtaaaacccgtgaagtgataggcattgcctttgacgatccggcttacgtgacgtggcttgcctataatcccgaacctgagacctcccggctgcgttacggctattcttcaatgacgacgccagataccttgtttgaactggatatggataccggagaacgacgggtacttaaacagacggaagtgcctgggtttgattctggctgttatcagagcgaacacctgtggatcaccgcacgcgacggcgtcgaagtgccggtatcgctggtttatcatcagaagtattttcgtaaagggcaaaatccgcttctggtttacggttacggatcttacggttccagtattgacgccgacttcagcagcagccgactgagcttgctggatcgtggctttgtttacgcaatcgtacacgttcgcggcggcggtgagctggggcagcagtggtatgaagatggcaaattcctcaaaaagcggaatacttttaatgactatcttgatgcctgcgatgccttattaaaactgggttacggttcaccgtcgctgtgttatgggatgggcgggagcgcgggcggaatgctaatgggcgtcgctatcaacgaacgccccgagcttttccacggcgttattgcccaggtgccctttgttgatgtattaaccacgatgctggatgagtcgatcccattaacgacaggggagtttgaagagtgggggaacccgcaggatattgagtattatgactatatgaaaagctatagtccttatgacaatgtcaaagcgcaggactatccgcacctgctggtgacgacaggattgcacgattcccaggtgcaatactgggaaccggcgaagtgggtggcaaaattacgcgagctaaaaacggaccaacgtctgctgctgttatgtacggatatggactccgggcacggtggtaagtcggggcggtttaaatcctacgaaggcgtcgcgctggagttcgcctttttaatcggcctggcgcagggaaccttacatagcgcatagacgcgcgcgcccgcaacggcttgtgagcgtcgcgggttattgtggtgttccattgctgcgttgctcgccagcctgaacatcttccaggtagtgtttaagcgtcaggcgaagttccgggctcatattatcaaggttattaaaaagccagcgtaaatagcccggatcgcgttttgcgacttcagataccgccttaccgcggtatttaccgaacgggaaagtggttaacagcgcaggacggcccgtgatattgaccatctcttccgcggtccagccggtggttcgcataatatcaatcagcaaggcggcggtgatatagcaatcataaagcgcccggtgatggtgcagccccggcggcgtttgtacgcttagtttgcgcgatttatagagcgccatattgctgtattttattcccggccacaggcgtcgcgacaacttcatggtacagatccactcacccggcaattcaggtaatacgcgtctgtcgaaactggcattgtgagcgacataccactcactaccgtaataaagcggtatgacatcttcaatccacggcttatcggcgaccatggcttcggtaatacggtgtatcgccatcgcctgcggcgtaatagggcgatcggggcgtatcaggtgactcatgggattgacaatgttgccatcaatgacatctacagaggctatctctacgatcccgccctgcagcccgcaggtttccgtgtctataatccgcaacatgattcattcctcacccaaagaccttagcgtaatggaatgatatcgccttgccaaccctcggttgtgcgcagacccgtcagtaatagcgaaccgcaatcggcacgaacaataagttgcccgctttcatcccacagcgcgctactgccacaggcattggccatcagtacggccagcgcatatttatgcgaaaaacgttgtaagcgtgaggtagaagcatggagttcaggctcgttaagacattgactggttgtgaataacgtaaatgaggggcctatatcaccaccttctggctgctcatccaccacgttgatagcgcttcgctgcctggcaatacaggcgccatgacttttgtgaaacatgagcggcgacgttagccatggggcaaaaatagcgatgccttttacgaagcggcagttatgctcaacaggcatacccacaatgatagtcatatggtgggtatcggccgcatgagtgagcggctgtaaaagcgcctcgtcaggcggggcgggcaacggtttatttctttcgtcgcagcctaatagcgacagtgacggaaagaccagcagttcgcactgttgacgagccgcaagctcaatatattccagatgatgggcgacatgctctgccggcgaagcgttcaggggcgcgtactgcgcagcggcaattttccaggaggacataatgacttccttttcatagtctctacagccattctaaaaagcataggttaagaatcgccttataatgtagtcgtctgcatgtaaggaagtgtaacgttatataatttttatttaactttgggttcgtaagggagtcgggatagtgatacggaagccagacgatgggcaatcagccgctcgcgaaaccaggcgcgtagatgctctggctgctcacgttcgaccgcctccgcgacaactggcatattgtagcgctctttaaatgccaccccagctgccgccagatccacattgactttatccatttccgcttgttcaagctgagccagattcgttttcatacgtgtctccttttttgttgccgccagaaggtactaagagtccgcggcaatggcaagatggaaatgatgatcctcgactcattgattgttgaaggttattctttgtaacgtaggtataacaaaaaggaatagtgaatatggcttcttctgcaccatcgcgacgtttagctttactgctgctggcatcgacatttgcgacgccagcggcctgggcacatgcgcacctgacgcatcagtatccagcagcgaatgctgccgttacggcctcgccacaggcgctgactctgaacttttttgaagggattgagccaggattcagcggcgcaaccattactggccctcagcaagagtccatcaaaacgcgcccggcaaagcgaaatgaacaggataaaacgcagttgattatcccgcttgagcagccgttaaaatctggcgcttacacggtagactggcacgttgtgtcggtggatggacataaaacaaaagggaaatacaccttcagcgtgaaataaatgatgctgacattcgtctggataactctccgatttattcattttgctagtttgatgctggtctacggctgcgcgctttacggcgcctggctggcacccgcatcaattcgtcgtttaatgacgcgtcgatttttacatctgcaacgacatgccgccgcctggagcgttatcagcgcggcttttatgctggcaattcagggcggactgatgggcggcggctggcccgatgttttttccgtctcggtttggggcgcggtactgcaaacccgctttggcgcggtctggatatggcaaattatcctcgcgctggtcacgctggcggtggtagtcattgcgccggtaaaaatgcaacgacggcttcttattctaaccgttgctcagtttatcctgctggcaggcgttggacatgcgacgatgcgcgatggtgtagcgggaacattacagcaaattaaccatgctctgcatttgctctgtgccgcagcctggtttggcgggctgttgccagtggtttattgtatgcgcatggctcaaggacgctggcgtcaacatgccattagcgccatgatgagtttttctcgttatggtcacttttttgtggcgggcgtattgctcacaggcattggcaacacgctatttatcacgggatttaccgctatctggcagaccacttatggacagttgcttttgttaaaatgtgcgctggtggtgcttatggtagcaattgcgctgacgaatcggtatgttctcgtaccacgtatgcgacaggaaaatccccggactgacctatggtttgtcaggatgacgcaaattgaatggggagttggaggcatagttctggcgatcgtcagcctgtttgcaaccctcgaacctttctgatggactggcataacgaatgaaaaaaatactccttccggcgcttctgctggccacttcgggcgtagcgttggcggcgccgcaggtgattaccgtaagtcgttttgaagtaggaaaagacaagtgggcgtttaatcgggaagaggtcatgttgacctgtcggcctggccaggcgctctatgtgatcaaccccagtactctggtgcagtatcccttgaatgctattgccgagcagcaagtagcggagggtaaaacgcgcgctcagcctattgccatcattcaaatcgataacccggcaaagcccggtgagaaaatgagtctggcgccgtttatcgaacgtgcgcaaaagctttgtgatccatccaatagctgactgatttttaataaaaaaccgtaaaccttcacgaaaaggcttacggtttttttatctctgatgacagacaatacgccaggttttttcaatcaccttcgtcacaaactggaaaacctggcgtcgtcatctattcttaaagagcaaggcgatttagcctgcattaatgccaacttttagcgcacggctctctcccaagagccatttccctggaccgaatacaggaatcgtattcggtctctttttatttcgattataaatcaacgggttatgtgttttccctcgaaatttcctcgaatttctgtattccggtctttttggttatatcacaatcaaattcagtttaacatttcttttacaacaaaatcagagcatcacgtaagctttattatcgcgttcatcgagatagagtttcgtggtgttctctgaggtgtggcccagtagtttttgagcgaattcctcgccgcgttcgtttttgtacagccgaccagccaggctacggatcttgtgaaatgtcggtgggttatcactacatttaacgcctgaaatttttctggcttttacaaatttctttgtcagcccatccgggtgaatattcccggttgggctatttttcctgattccggcactgatcatgaaatcagttcggcttaccagtcggcagcgatcgattaaggcgggcaacggcatagacatgagtaacctgtgcatcttcgttctcacccggacggtgtaccagcttctcttccagaccaaactcgaagctgaaatcgtcaccttcacggacaacgcgcgcggaaaggctggcaatctgtccggaacggcgggcaaggtcgatcattccccggtagccaataattaactgaacgtttttttgcctgacttttcgtttttgtttccgaacggcagcagataggcatgaccgagcgcgccgccgggttccagcccaagctgggaacactgaacgatggcgctgacaaaactcatggtgtcacagtcacccagcgccggaacttttcggatttccgttgtggcataccgccggtacgccgtcaacttgcagcgccgcgtcatccggcagggccaaccccggcacaactgatgatggaaaaattcagacggcgtaaggcggcgggaaggctttaactggggggacttatgagcagaaattacacaccggcgcagaaagctgaaatacaaaagcgcctgacggaactggtacgaacacacggtcggatgacgtttggagaacttcggaagataacagggttaaccatttttacagcccgtcactacctggaaaaggcggaaagttgtggggatctgtatcaggccgggagaagcggtatttttccttcggaacaggctttcctgctttggaagtagaaacgtgaagatgccaggattacccgctttctgaaaacgccggaaggtgtcgtgagttcctacgaccggaccagaaacgttatctgtacggagtgccggaacagcgtgacgatgcaaagggtactggcattttatcggggaaattaccgggaggcgaaatctgcatgaaaatcgaataatataactttgcagaggtagcgaatatcgtaatcatccgtttggcatttgaattccgtgagcacagtcgtgttgtgaatgtcgccttgttcacaacaccaggaatattccactgtcaactggtgtctgcggctggacataattttatctgatattcaggctgtaccagcgcaaaggttccgtgagtccgactgtcttttttgcttccaaatattcagttttaattatctgagtatggcaaggtgatcttctgtatcaaacaccgggcaactggttttactttacccaacgattacgtccctgttgtttagcccgataaagggcctcatccgctctggcaataatgccggtaacagtgtcaccggctgtggaaagggtgatgcccatgctgacggtgaccgtttcgcttaccgcagatgctacatgcggcagtgcggtttcacgcaggtttgtctgaatacgtttagcaaccagtgcagcttcattcagcgacgacgaaggcagcacaacgacaaactcctcgcccccgtaacgtgccaccaggtctgccggagtacgaatcgacctctttactacacaggccacctttgccagacaggcatcgccagcctggtgaccataattgtcgttatagtttttgaaatagtccacatcgagcatgatcagtgcaaacggctccgtctggcggagagcatccccaagaaaactttccattgaacgtcgattagcggtcccggtcagtgcatcctggtgagccataacgtcgagacgcgcgataagcatccggttttcctggtaacgcaaccaggcttcatcaaaccagcgctgcaggataaagcgaccataaatgagtatggcggtaagagtaagccagactaataaaaaccggatattcacatactggttaagctgcacgctggccagtagggcggtcagccataacgggacgatgaaaagtagcaacgctggcagatgataataaagcgcagccagcgcggtaagcataaggatgacactgagaggccaggcaaaaggcagttgccaccagacaataaaacagtagctacaatagctccacatcagactgagaatcagcagcatcaccagacaaagaggagtaaatctggccggaaggcggtaaatgaaaaggagtatcaggaacgaaaaaacaataatactgcccataatatcgtctattaaaggcagtattccagtctgtgcactgatcgacttgtcaaagtcactgatgagtatgtggcgaaataaaatgataagcgcaaagctgatattcacaaatgtgaaccacggaatacttacacgtagcgcttgcctgaccatatctttatgatcctgccatacccttccagcactggaggtacggcgcctgtcgtccgaatcctgccccatccttaatcgcctcatataatgaataattactatccagtgtagtgcggagatacttcatggtgaaaaatggaaaagctatcaggccaggctgcatttttggctgatgagatgatttttgctccacagtgacgaacttatagtcacaattcctgtagtaggggggagaattatagtgtttcccggaaactggaagcgagtttaccccacttactaaaagaggatgtaactggcagacgtaaaacacgacttatttgtatccataaatagcgaaatgtaacgttttggttatatttaaaagagcgaaaatggtcagcaataactttaattgtttgaattaacagataattaatcgaccagactgagtgatacagaatatttttacatgaggggtacaaatgagacttaagtcgatcgttaaaagttttgcgctggcggggctactctcttccactgcgctgacacctttatttgcccaggaagccccaaaaggtgccactgcttcaaccaagcaagctaacaatgcgctttataaccaacttcctttctctgataacaccgatttcacgaatgcccataaaggctttattgctgatttacctgcagaggtgattaagggagagcaagggaatgtcatctggaatccacagcagtacgctttcataaaagaaggggaaaaatctcctgacactgttaaccctagtctgtggcgtcagtcccaactaatcaatatcagtggcttgtttgaagtaacagacggcgtctaccagattcgtaaccttgatttatccaacatgacgattatcgaaggtaaagaggggattacggttgtcgatccgctggtttctgcggaaacagccaaagccggtatggatttgtatttcaaaaaccgtggcaataagcctgttgtcgccatcatttatactcatagccatgttgaccactatggtggtgtgcgtggcgttgtcgatgaagcggacgtgaaatccggcaaggtgaaagtgtatgcgcctgctggctttatggaggcagcagtagccgagaatattatggccggcaacgtgatgagccgccgtgccagctatatgtatggcaacctcctgaaaccagatgcctccggccaggttggcgccggactggggacgaccacctctgcggggacggtgacactgattgcgcccactaatatcattgataaagacggccagaaagaagtgattgatggcctgacttacgactttatgctggcccctggttcggaagccccttcggaaatgctgtggttcatcgaagagaagaaactcatcgaagccgcagaggacgtcactcacaccctgcataacacttactcgctacgcggcgcaaaaattcgtgagccgttgccgtggtcgaaatatatcaacgaagctatagtgcgttggggtgacaaagctgaaattattatggcccagcaccactggccgacttggggtaacgagaatgttgttggtctgctgaaaagccagcgagacctgtatcgttatatcaatgaccagactctgcgtatggccaatgaaggtctgactcgcgacgaaatagcggccaacttcaaactaccggatagcctggcaaaaacctgggccaaccgcggctattacggctccatcagccatgacgtaaaagcaacgtatgtgctgtatctcggttggttcgatggcaatccggcaacccttgatgagctgccacccgaagaagcggctaagaaatttgttgaatatatgggcggtgccgatgcgattcttcagaaagccaaagcagactttgaccaggggaactaccgttgggttgctcaggtggtgagtaaggtcgtgtttgccgatccaaataaccagaatgcacgtaaccttgaagccgatgcgttggaacaattggggtatcaggctgaatctggtccatggcgtaacttctacctgaccggtgcgcaggagctgcgtaacggtgtggttaaaggtccgacgccaaatacagcaagtccggataccgttcgggcaatgacccctgaaatgttcttcgatttcctggctgtacatatcaacggtgaaaaagcgggtaatgcccgggcggtgtttaatattgaccttggcagcgacggcggaaagtacaagcttgagctggaaaatggcgtgctgaaccacacggctaatgctgaagcgaaagacgctgatgccacgattactctgaaccgtgacacgctgaataaaattatcctgaaggaagaaactctgaagcaggctcaagataaaggagaagtcaacgttaccggtaatgctgcgaaactggatgagatgctgggctatatggacaagtttgagttctggttcaatatagttacaccataaatagattccctgcggcgtcaatgctgcagggaagttacttcagacaattctgtacgtttttcatactcgatttttccttcattctttatatcttgcttcattttatgtatttgctgctgaagcacatgaccctgatgccagtcagtcctgattctgttatgcacagcctttttcatcagatgacagtaactggttgttgcgtgattcaatggtctgcgagtctggtcaacatgcttttagttagttaaatgtgattctactaattcgtaatgcgaaggttataagtttgattcctattattgcaccatttcaacgttactgaaacttccgtgttagcccataaccattccagtttctacaagacaggtgcttgctatatatttaccaatcagtcattttaaaagtgcgtcataaccggagaactgtcctcgtcaggaggcctgttttcagaaaggcaatatcctgcttcgacagtagcttatatgtgaccgggttagcagcacattcccctccgccacattccagtacagttgaaataaggttggcagtaatcagtaatagaaatacccaaccgacaatactgaacaggttcggattaatattcaatgaacgaaatgcagcattcatgctactgattgccagaactaccgcaacagcaataataatgagaattgacgtaatcagagtccaggtataaaagtgtaatccaaaaaatgcagaaccatatcctgtgtcaccgggcatgatatgcaaacatatttgccgggatgccataactccggtcaggatactgccaataattaccatcccgtaatgtatgcctcgtagaccaaagcagaggttaaataaaaagccaaaaccggcgatgatgaggccagcccgctgtaataagcaaattggacaaggcagctcatgcctaacgagttgataataaaaggctacaaccagagcaacgcatatcccaaggagtcctatctgattaatcagatgaacaaatgttgttggatgatgatgcgttttcatacacactccttaaaatgacaaagttagcgaattggtcatatgatggatgaatgataaaatagtgacgatgagtaaaacggcccatagaatgtagctgactttatcctttctgtttatggctcccattgccacgctcagtgcaagcaagaatggcagaaacatgaacataaaaaactcctttattacattgcttgttaatataatcgctgtgtattaccgggtctgtattccagcttatccaccccgcattagctggagctcagtaaggcatcaggaattatttgcgttattataaatcgattatttctgtgatgaattatcccgacatctgctggttacagggatatttctggcgacaagagtaagaaatatcccgatagctaatggtataataagcagcattgagtgtgttgaaatagcatatccataaatatagtcttccagacttaccgcaatcagcggaaagataagaaatacaagcgaagcctggaaggcgttagccttttgctgaagcgcaaagtagcacaggataccaaaaactccggcaaaagccccgagatacagggtagctaatattgagtgtactgagaaggttgatacttgtggtctttcaaaaaaccatcctgtcgcagaaagtatcaacccagctaaaaggcacgggagcgcattaaatgtgataacagagacagtacaacttcttttcttacattgtgtatatattatggcatggattaacacagcagaaataagcgcagtgataccctgccagtgactctctgtacttgtattcgtttcttcaagaagtatccccgtcaatgcagtgattgcgatagttaagcccgcgatctgcattagtttcgctttttcatttagaaacaaaaccgatgctatcaaaacggccacaggcatattcgcaaagataatggcggcaagcccagagttgacataggtttcaccataaatcattagtgagaaaggaatagaaaaataaaagatgcaaatcacaaactggaataatcgttgtccgggaggaaacaacaggtttttttttcttaaccatgcaatgatgattaaaaaaggtgctgcaaacataaacctcattccggttgcaaacactggagggatagtttcaacggcaattcgcatagccaaccatgtagtcccccaggtcagtgaaactagcatgaataatatagatatcgacaccttgcgcataagatcctctccataaaaaaattaatttagctttttagctagaaaaaagtagcgttttcttcactgtgttttttatatgtttagataaaaatttctctatcagaagacgcagttatgctgaatgagaaaaataagaaatgactcaggctgttaccacacgattgtccactgcgcctgcaagacctggcagcagttgtcgatttaatatctattcttgctggaaggcataaaacgccttgaagatgaagagctcatcattagtcgggttcccttgttgagccaggacaagtttaacttatcgctttcaacccttacgatgataaatgatcttatccacccataatggacatacggctaaatgagtaaattctcaagtaagaggcaggatctgtatcaaccagtaagaagtcccggaaacagcaccggcggaattccgtcaggaagctctgaaactcgctgaatgtacgttgcccgcgaacgattgttaatcagcgctatagcaagaataattgtttgtttcacaaggagatagaaaaactatagctttgcgccggggcggaggcaggaggagataactcgttgtaatagaatgtttttatatggcgaccttaagagaaatgctttcgcctcggtataccacccgctatgaagacctgcttcaggttaagtggcaggtttatccagattttcacattcctgatgtgatggaaccgcagccacatcgtatgcaagaacgggctgcggcaagctggcgatcgttcgatagtgcgagtattgaatggctgccagttgcggcggattttacttgttcaggatgactaaccaatgtgtttaatctgaaactagccacctgttcaacttttcgcgatcgcttttgttggcatcactattaagccttcgtctacatgggtatttggcatcgggagtcccccaatggaagaggggagtgatgtattgggcagtgagtttgtttggtcgggagatttatacgcaaaatggcccgaaatacgtccgaattaaaacgtaaaaagtgataactaattgaatctattagaatcaaaaataacgtgttctaatcgttaaaatcacctaattaatatgtaacattatgaatttaaagggaaagatcaattgttgccgtaaacaggaatcgtattcggtctctttttgtttttcttataaatcagttgcttatgatcaataatccgaaatttccgaaattttccagaatttctgtattccgggctttttcgttatatcagatccaaatccagtttaacatttcttttacagcaaaatcagagcatcacgtaagctttattatcgcgtttgtcgatatagagtttcgtggtgttctcggaagtatgtcccaggagtttctgagcaaacccttccccgtaagcatctttatatagtcgtccggataagctgcggatctcgtgaaatgtcggtgggttatcactaaatttattccggtaaattttcgtgccgcaacaaattttttagtcaggctgtcaggatgaatactcccgttcgggcggtttttgcgtatgccagcgctgataaggtattcgctacggcttaccaggcggcaacgatcaatcaccgtactgaggcgtaaacccatggaaggaggggtgagcgaaagtggcagagcgattttcatctcggtcttgattggcttaacgtacagtcgctcatcaataatgtgactgaactgagactgtaattaaaattgtgtaattgcctgtttttgatatgttcactccagtaacggagacaggcaattatggacgaaaagaaactcaaattccttgcggctgaactggctaaaggccttaaaaccgaagccgacctcaatccgttttcccgtatgctgacgaaattaaccgtcgaaacggcgctcaatgcgtagctgactgaccaccccgggtatgagaaaaacgcccccaaaacaggctcaaacacccgcaatggctactcgtcaaaaacggtgttatgcgatgacggcgagatcgaactgaacacgccgcgtgaccgtgaaaacaccttcgaaccgcagctacttaagaagcaccagacgcgcattacgcagatggacagccaaattttatccctctacgccaaaggcatgactacccgcgaaatcgtcgccacctccaaagagatgtacgacgccgatgtgtcaccttcgctgatatctaaagtcaccgacgccgtaaaagagcaggtcactgagaggcaaaaccggcaactggatgcgctgtaccccattgtttatatggactgcgttgtcgtcaaagtccgtcagaatggcagcgtaatcaacaaagccgtcttcctggcactgggtatcaacaccgaacgccagaaagagttactgggtatgtggctggccgaaaatgaatgcgaaaagttctggctaagcgtgctgacggagctgaaaacccggggccttcaggacatcctgattgcctgtgtggatggtctgaagggcttcccggatgcgataaatagcgtcttcccgcaaacccatattcagctgtgcagtatccatatgatgcgtaacagcctgaaatacgtagcctggaaagactacaaagccgtcaccagcggccggaagatggtctatcaggccccgaccgaagatgcggtactgatggcgatagatgcgttcgcgaaagtccgggacgataaatatccgcaaatcagcaaaagctggcgtgcgcaccgggaaaacctcaatacgctcttcagttatccgccggatatccgcaaggccatctacacgacaaacgcagtcgaatccctgaacagcgtgatccgtgccgcgataaagaaatgcaaggtgttcccgacggatgactcagtacgaaaagttatttatctggcgatcaaggatgcgtcaaaaaatggagtataccgctccagagctggtggctggcgatgagccgttttattatcgggttcggtgaccgcctgatgctgataattttagtcgtgaggttctttcttctgcaccgggtgggcgcatttcataactgcaggaccatttgctgaatactgtatagtccagtactttgcatgttgttgagatcagtgtgcaattcctcggtactggcttgttctgtataggtctggagatttctgggtagtgtccttgtggacctgaacatatgtttttgattgaaaatggcatcgtgttttatcatttacgctgtgaaatgttgttttgtgctcttctgttgtgattggtgatgtgacgggatcgtccatgcacccttccttttattgacggcgtatcagtccattgatgccatgctcgcttaatttgtccagcatcatcaagccgtcgttttctttctgctgcaattcaagcaacttaaaccgtatttcgttaagtaaaggtttaataactccgcgcttgcgaaccacctttctgataacgtctttttcgaagtataaacggcagaagtgattttcataattcgcctacactcttcacccagcgctggcaaatcttcaacgctgaaaggctggggagaaaggcgtccagttgctgaacggagagcgtaccaaacgccctgattccacgcgttatcaaacttcataccgtggtcatcatccagacaaggcgcttgaggttgcacatatcttttggggaaagaggttcggcggtggatactggatatcctggatcgggaagtgggttccactggtgccaaatacagtgggctggtaaaccgggtggatacctcaaatcctgacaggccagagtatcagcctgataaaatcgtattactgatttctaaccagtggcacattaattgtaccagctcagactccaactgacagtttgctttaagcgagtagcggacgtgacctgccccgcaggagtaaaaataaactttctattgatacatttaattaacttatttataacgttatattccaaatgcaaacttgttcaattggatatgtatggacattcaaattacacatcaagttactgaatttgataaagaagaactattagccggattaagaagctacaatgctcagttcgtcgattttagtaaaaatgggcagcttggggtctactgcagaaacgaaagcggcgaaatggtaggcggattaattgctgacagaaaaggtccgtggctttgcatcgactatctttgggtaagtgaatctgcaaggagccgcggtctggggagtcaacttatggagatggccgaaaaagaaggtttgcggaaaggctgtgttcatggacttgtagatacctttagcttccaggctctccctttttatgaaaaacagggtcatatacttcaaatgtcgctaccggactttcctaaagtaggttcgcaaaggcattatttaattaagcctgatttatagctttgctacatttgaatacccatagccttatgaaagctgcaatcaggtagctttaaaatatatcgtattgttggcctgtacacaccatgttcagcgtccgcttctggcgcagggcggacagtcagattaggtttggcgctgtgccatagatatgtcagctcacatttgagctaataccccctggcacggctagaggtactcagacagccgcttgtaggcggcatggtacggatacaaaaacatatagcgctgttatataaactgtaaactgggctgtgcgtataatacgaatctttcactcagagaaacctgctgacagcgttagtgctccattaattaattttgtactaaatctctgtggtatggcacagacgtttagaagacaggtcaattgcgagctgctggctgggatttcgtcgcgccactcaaaaatgcacagagtttttcacccgccgtcaatggctcaatgggcgtttttccgagggcggtctcagtcatgacgatggcaggaccaataagcatggaccatacttcgctcgcgtcttgctcaagcgatgtgaaggcaaggaacagtgtcttatctgaaggaaagcggtgctgagtattaaaaagtttcagccaggcgcgggactgccggtcggcctgtgttgagcgcgtgccgaagcggagtactctttttagtatggcgatacccacaatgcctggccccagaataaagggactcccgacgtttatggtgacgccgaccccgagaaaaacgagggcgaatgacagcacgttatctactcttctggtaagagtactgtatagtttttccagagagtaccggtaaagaatttgataactgatttcatctttgctcatacatctccagatggtttttcgattacgctccggtatgctcccggaatcctgacagattctgcaattatgccacacttcctggagagtattaattagatagaatataaatagcaggcaaatattttgagcttttagtcgatatcgctttgaatatcatttctcctgcaccaggagatgctgttgtcgagcatcgtgtcaaacgttgctgcgtcggtcggactgcacaggataactctcgcagtcagactctcattatggtctctaaatggataacccgcagtcgcaacacgccggatgtcacgactgacgctattattacccaggtttgttaaagcggcatgaccacattttctatatataataattggttgtctttcgaccagtattgtcgagtttttttgtttaattccacaatccatttaaaaacgcctgccgttgccagatcggtacagtatttttcataggaatgctcgcccgaaaagtgtttagctgaagtcaattttattaattgcgtatttggtgttgaattgactttaatcagctttctattgcttttaatagaaatgaaatggcctgcatgagtgataattttcacattaccggtagcaacaaaatagatgtaataagcgatattattatattccagatcgattagaaatgcgttgaaatttgcatcctttctgacacgctcgaaaaagtggttaagcataagctgtaattccatttgttaacctattgtaagttataatgttgaatgttgtgttagagtattgttgtttaaaagcagctatacagatatgctacctaaaagcaataataatcgtctggtatcatatagtttacgttatgattggaatagtgttgcaattgttactgattatttctcgtagcgcgtttttttgaccactaatagatgagtcaatccatttcatttgtagtttttctgaacgccatgaaaagtcataatatataaaaatcagttaattaattgatttttagataaggattacagtggcggagaggtttggcgtggcgactttataggttttgaaaaagcggctaactcgctggcaggataattggtagccagcctgcgaatgggggcaaaatcgtaacaacatcagcataaataataatgttcatgaatgttttgtgtgacgcagcagttgaattgaagtgatgttttgcctgttcaggattgtcccgataaaaatgttcctcgataaaagtcgatcaccttgcgccgaaaaaaaacaggctaagtgacagaagaacaaaatccatcaggaaaataaaatttataaatatcaatgagtaaaaatggttgtggagaaggtggctattttttgaaagcaagaaatataaacaaagtgtagctatgcatagttatctaaaaggagaactaccgtgactaacataacactatccacccagcactacagaatccatagaagtgacgttgaaccagtaaaagaaaaacaacggagaaggacatttttgcaaaaagtattactgccgttagaaatagctttatcagcctgtcgacgagtctgtcagatcgttttagcctgcatcaacaaacagacataccgactacccattttcatcgtgggagcgcctctgagggtagggcagtattaaccagtaaaactgttaaagattttatgctgcaaaagctcaatagcctggatatcaaaggtaatgcgagtaaagatccggcctatgctcgtcagacatgcgaagccatattatcagccgtgtacagtaataataaagatcactgttgtaaattactcatcagtaaaggggtcagtattaccccctttctgaaagagataggagaggctgcgcagaatgcggggctacctagggagataaaaaatggtgtatttactccaggtggggcaggggcgaatccttttgtcgtccccctcattgctgcagcgagcattaaatatccgcatatgtttataaatcataatcagcaggtgtcttttaaagcgtatgctgagaaaatcgttatgaaagaggttacgccgctgtttaataaggggacgatgccgacgccacaacaatttcagttaactatagaaaatattgcgaataagcatcttcagaatgcctcctgaagatagcaaacacaataccgctattaaccgtatgaattaatagcagattttctgaaactatatattcatttttatggcgacgcttttaacaaaacgtcgtcatatttattttaatataaaaatcaaatggatacacttaaaacttaaaataattgttattactctaaatgccggtataaccagacagctttttttgaaacgctgcgtgttgttaagtctatgatacccgcgcacggatgatgtctcgataaggattaatggtctgttaactgtcaggagaggttatgccacctttaaaaaaaattgtgctgcgcctgtttgtgggggcgatggtcgccacggtaacgacacctgcattggcgctggtttgccttgaggatcactccgctaaagagtgtgctatatcgtgtgctgaggtgatgtggtttatgtttccgatatgtttttaaggagggagaatattgaacgcgaacaggtgatagtgagtagctcgctgcgccaggggataacactcccctggtgcagtcagttatattttattgcgatgataacaaagcatttactcgctactgatgaaattcgctatttacaacagagcacgtttactaagcaagaaaatctgcacacgctatctttttatatctatcttggataatgaacgacaggaaaaacatgatgcggcctgaagagatttatcagcgaatagaggcaaagaattggcggcatgtctgggtggtcggcgatattcacggctgtttttcaatgttaatgaaaaggttacgtgagtgtcaatttgatccgcaacaagacttgttagtttctgtgggcgatctcattgatagaggcccggacagcctgggttgcctggctttactgcgtgagtcctggatgacggcggttcgcggcaatcatgaacaaatggcgctggatgcgcgggcctcatcgcagtcgacgctgtggttgatgaatggtggcgactggtttacccgcctgacggctgaacacgctgcgcaagctgaagcgctttttattctttgtcagcggctgccctggatactggaagttcgctgccgccatagcacgcatgtgatcgctcatgcagattatccagcgtcaacctatcaatggcaaaaaaaggtcgacttacatcaggttctctggagccgcgaacggctcataaataagcgcggcgggattagcggagccgatcatttttggtttggccatacgccgttgcgtcggcgcatggatttcgccaacatacactatattgatacgggcgcggtatttggcgggcaattgacgttagcgcggatacaatagcggcatcagcgactagggttaaaaatcgctatattgctgcgcaggtcgccagaagccgtcgataaaatcctctaccggaaaacagccgccatggcgaatccgttgatcgtccatcgaataaagacactgctgctcggtatcgtagatgtccacgacaatatcctcgcatcctccatccaggtaacatacaaaaagtaccagcgcgaacattacatcctcaatgttaactactttacacgatagtgtaggagaggttagcgcaggggggaaatgagaaaaggaagaataaataacccgcctggcgacgggttctttttgagtcaggcaagacgcatgacccaggcatcagatttaggatcgtaatgattacggaacaaaacggaatgttccccgttgagaatggcgggaacgctggtttcggcatcccaggcgtccagttgcatacataaatccggatcggatttacaggggattgttaacgttcgctcccccggcgattcgccatgtaattcggcatcgtcgatttcaaaagcgccaatgcgcacactggttttcatcatcgtgctctccgttaatacgctaattgtggtacgaccagtttagccgtccatttttcagcgtagtcaacgtacgcaaaagcgccagtcaaaaagtgcggtttttttgtgcgccttttaactattaccagtaaagagttttccatcccgcaccagttcacgcgggtaactgttctttattctggcgccgatacgttttgccagaccaagtggctgatgctggaacgtcaccaggacatcatcagcggcagggggtgtttgcggataaatatcccgaccgcgataccactcctccgcctcttgcacagaaagttcgaacgcgtgagcatgagtcgggcaggcaagggctatcgtcgcctcatgttgccagcgatagcctttattatgactttcggccagcttaatgccgagccgggaaaaacggacttttccgatcagtgattcaatctctgccgggaacagccagacctctttttcacgctgccaaagatggagattttcatcccatagcagtccgacggcgttggccgcctgggtaacgtttaatgcttcgcggcctttgagggaggtaaaaggaaacgcccccactttataccccggcgcgggcatggctggaagggatgacattttacgcagacgtgcgacgaagaatccttcgcagtcgtaaatttgcgggaagacgtgcaggaagccttccggggtgagggcgcggtcagcgtcaggaaacagatcacccagcggcaaaaattcaacggcgtcggcgtaggtctctttcagccagaggcagaccgcttcgttttcctggcgatttaacgtgcaggtggagtagaccagcgtgccgccgggtcgtaaagcatgaaaagcgctgtcgagcagttcccgctgtgtcgccgcgatatccagattactttctggcgaccagttttttagcgcatcaggatctttacgtactacgccttcgccagagcagggcgcatccagcaggatagcgtcaaacatctccggtaacgcagcgccaaatacgcggccatcgaaatgcgtcagtgcggtattggcgattccacatcggctgatattagcgtgcagaactttgacgcggctggccgaaaattcgttggccagaatggcgccgcggttccccatgcgggcagcgatctgcgtggttttggagccaggcgccgctgccatatccatgacccgctgcggatgattatcatcggcgaacagggccgcgaccggcagcatcgaactggcctcctgaatgtaaaacaggccgcttaaatgctcagcggtactgccaagcggcaatgcctcttcatcatcgcgctcgatccagaatccttcatgacaccacggaattggcgtgagcgaccagccgtagggcgcgattagggcaaggaaatcagccacggatattttaagcgtattgatgcgtatactgcggcgcaacgggcgttggcaggccgaaataaattcatcaaaagagagcgtggaaggcattgcttcacgcatttgcgtcagaaaagcgtcaggaaaatagacagcgtgttgagccacaggtgtatcgccggcaaaaaaacaggcgcgcagtgtagcataaaacgctccggcgcgagtacgccggagcctggtgtttaacgtggcagagcggtaccccattcacgccactctttcggttcgctctcttgtaacaggaaatgcttaccggcttgcgcttttggcgccagcggcgtacctggtggagtagcgaaggcgataccgccacggatgaattgattaaatgtccccgttttcaccacgccgcctgtcagaccaaagtcgagactatagccggaggcaagccagaatacggagttattacgcaccagatattggtaacgcttactgatgcgcaaggtgatcatcacgcgatcggagagcgaccccagggacattccggtgacggttcccacttcgataccgcgaaacaggacgggtgtgccaatattaagcgagcctgcttctggcgcctccacgacgatgcttaacccatccagatagcgtgagtcggtaatcgtggcttcctgcagttcaaagtcgcgccgcgccgcgccgcgtcctggctcaacgttaatatagggctggagaatcgtatccagatgctcgacgcccgccgcggagatttgtggcgtaataacggaaaaacgtgtcccggcgcgggcaaatgtttgcacgtactccggataaagtacggcttttgcctgcacttcattacgtgcggtgatcaattccagcgtctggatctggccgatatcaataccgaggtaacgaatgggcatcccctccgccaattttccggcgtcgaacgcgtgtagcgtaatttgtccgcctaccgcgcgggcggaagtttctgaagcataaagaatgcgtttatcgcctttgcgccgactggcgctggcgccgctcaggttatcaaaactaatggcccctttcagcgcacgggagagtggcgaggcctgtaccgttaggccgctgccgttaagttgcaccttcgcgccgccttccgcccagaacacgctattgctggttaacaggtggcgatattccggcttaatatgcaggtcgatgtcaaaggtattggcgcgtgggcgaacggtgatgacttcgcctacttcaaattttcgatacagcacgacggaacctgcctggacatccggcaacgtttcggccgtcagcgtcagggtggtagtcggtaagtcactgaggctattttccagcgctttttccaggttagcatagagcgggtaggtggatttcatcttcccgctcgtaccgggtaaaatacgaattccgccgtcaatccactcgctggcgctggcgccgaggaactctacgccgtcaaggccgactttgacatccacccggctgttgaccacgaatttactgtcgccctgtaccaaatcccggtgctgcggttcaatcgcgacgatgaatgacacgcctttactggataagttgcgctcaatgacctggccaatttttacgccatgtaaaattaacggctggcccggttcgatgccgtaactttccggggccgtcagcgtcagggttaaggcattcgcctcatgcagcagggctttttcacccggcaccaccacaaattcactgcgtggttcgccgtcgcccggcaccagctcgaaggtttttccggttaacaacgaactgatattcgcgtcacttagcgacagtttgggattgcgtaactcaatacgcgtattttcccgcatcagcggaacaacgctgggatcgacggtcatctctccggtgactttgccgccagggttgagcgtcagtttagaaagctcacccacctccagtccctggtacattagcggcgtagattccgctttcagaccgtctccgctgggcagctcaagtttaacgattacccctcgttggctgtgggctaaatctttatataagccgaacgtgtcatcctgggcggcgggtttggaattgtccggtgagtcaaacgcaatcgcgccattgaccagggccgcgaggctctccagtttcaccttcgcgccgctcaggcttagatcggcgtcaatgccggagacattccaaaaacggctgccttttttcaccagatcggtaaaccgtcgctcaatcagaacgtcaatcgtcacgccctgtttgttagggttaatcgaatagtcatacacccgtccgacagggattttacggaaatagaccagtgaaccgctattaagcgaaccgagatccggcgcattgagatgaatcatcagatcgccgttgctaagccggtatttaggctgtgtatctagggcgacgaaatgatctctgggcttgcctttacctggcatcataccgatgtaattcccgccgaccaacgcatccaggccggaaacgcccgccagcgaggctttgggcgtcaccagccagaattgcgtctcttcgcgcaacgcatcttccatatctgatttgatactgacgcgaacttcaattttgcgcagatctttgctcagactgacatcttccacggtgccgacttctactccctgataacgcacgggagtacggcccggtacgataccgtccgccgacataaaatcgatagtcacgctattgccgcgatcctggtagctatcccataccagccaccccgcgatcattagcgcgataagcggtagcagccagaaaggtgaaatacggcgtttggttttaatttgcgcttcagtcttcgaagcgggcgtttcctgactcatgtgcatcccaaagtaagcggctatccagccattccactgcaagaatagtcaaaattaccgctgcgccgaaataaaacgcagccggtcccatagtaaaagccagaatctgatcgcgattaatcagagacatggttaacgagataacgaaaagatccagcatcgaccagcggcctatccatgtcaccagacgcagcaacagaattcgcgtccgcagtccctgttggcatttaaaatggatactcaacagtagcgtaaacatcacgatgactttggtaaacggcaccaaaatactggcgataaaaacgacggcggcgacggcgatattgctgctggcaagcgacataatgcccgacaggatagtatcttcctgacgcccgccattaatgtagattaccgagataggcagcaggtttgccggcagcaaaaagacaatagacgccagcaaggccgcccaacacttctgtatgctctgttttctgcgtaaccgtagcggaatatgacaacgcgggcagcgtcctttcgcatccggatagccgctaaagtggcagccaagacagacgcgcaatctttcgtccgcacgttgagcagggtgctgcggataaaatcgttcccatagttgctccacattcagatgaatcatagtcagaatgctaagaaccaccaacgagacgaacgctaaaagcccaatgcccggctgcagaaaggcatagtcctgcactttgatagaggcaacgccaataccgaccagatagatgtccagcatcacccactctttcagtttttccagcatcagcaggactggacgcagattcatgccgagaaggctgccaaaccacaggtaagcaattgaaaaaaccagaataagcggcgcgcccaccacgcaaaagagcaccattgcggcggttaacggatcgccctgctgcgtcatttgccagatgccgtgcatcacattggcatcaatgcgtacgcccaacaggtagatatggagtagcggttcactccaggcaaacggcatcaatagcagcatggttactgccatcgcggtcagccgcgtcagcgaccagtcgcgcccatcgcgaattttggcctggcaacgaggacaataagcgctttgatgagcgctcatctccggcaagctgaacagcatgtcgcattcagggcagcgctggtagtggctgcgcggcagcgcttcgctaactgacctgatcgttagcttttttgttggcgtgacgtgtgaggtgttcagagccatgtatcgtgaatcaaagtgttagaataatgtaatcttaactcatgacaggaataatcttgaacaagaacgcatttaatgcttattttaatagcctgtgtttaggagtaagaccacgaagtgattatataatgagcaaaacagaactatacgcggcgttaaaccgcgattttcagtcgttaatggcaggtgaaaccagctttctggccacgctggcgaataccagcgcgctactgttcgaacgtcttaccgaggtgaactgggcgggattttatctcctcgaaggcgatacgctggtgttggggccgtttcaggggcgaatcgcctgtgtgcggattccggttggtcgcggcgtgtgcggcgcagcggtagcgcagaataaggttcaacgtattgatgatgttcatgcgtttgacggccatattgcctgtgatgccgccagcaacgccgaaattgtgctgcctgtcacggttggcgaacggattatcggcgtgctggatatagatagcacggcgtttggccgttttaccgaagaagatgaacacggcctgcgtacgctggtcgcacagcttgaaaccgtgcttgcaacgacggattacaaaaaattctttgcgagcgtcgcaggataatcaacggataacgtagcaattactgatagcgtcattataatgacgcctgttcatgcctgctgcttgttggctacgtccgttgtaatcaggaaatttcatggaaaatcaacctaagttgaatagcagtaaagaagttatcgcgtttctggccgagcgttttcctcactgttttagtgcggaaggcgaagctcgcccgctgaaaattggtatttttcaggatctggtagagcgagttgggggcgaaatgaacctcagcaaaacgcaacttcgttccgctttacgtctttatacttcaagctggcgttacctgtacggcgttaagccgggcgcaacgcgcgtcgaccttgatggcaatccgtgcggcgagctggaagaacagcatgtcgaacatgcgcgtaagcagcttgaagaagccaaagcccgtgttcaggcgcagcgcgcagagcagcaagcgaaaaaacgcgaagctgccgcggcggctggcgaaaaagaagacgcgccgcgacgcgagcgtaaacctcgcccggtagcgcgtcgtaaagaaggcgctgaacgtaaacctcgcgctgataaaccgacgacgaaagcgccgcgtgcgcctcgcgaagagaagcacacgccggtttctgatatttcagtattgaccgtagggcagtccctcaaggtgaaagcgggtaataatgcgatggatgccaccgtattagaaattaccaaagatggtgtccgtgtacagctgaattcgggtatgtctttgattgtacgcgcagaacacctggtgttctgaaacggaggccaggcctggcatgaacactttttttaggcttaccgcgttagctggcctgcttgcattagcaggccagtccttcgccgtggaagatattacgcgtgccgatcaaattcccgtactaaaggaagagacgcaacatgcgacggtgagcgagcgcgtaacgtcgcgttttacccgctcccactatcgccagttcgatctggatgaggcattttcggcaaagatttttgatcgctatctgaatcttctcgactatagccacaacgttttgttggcgagcgatgtcgagcagtttgcgaaaaagaaaaccgtgttgggcgatgagctgcgcacgggtaagctggatgttttttacgatctttataacctggcgcaaaagcgccggtttgaacgttaccagtacgcgctaaaagtgctggaacggccaatggatttcaccggaaacgatacgtttaacctggaccgcagtaaagcgccctggccgaaagatgaggctgagctaaatgcgctgtgggatggtaaagtgaaattcgatgagctcagtctgaaactcaccggcaagagcgacaaagaaattcgcgaaacgctgacgcgtcgctacaaattcgctattcgccgcctggcgcagaccaacagtgaagatgtgttctcgctggcgatgaccgcttttgcgcgtgaaatcgacccgcatacgaattatctttctccccgcaataccgagcagtttaataccgaaatgagcctgtctctggaaggtatcggcgcggtgctgcaaatggatgacgattacactgtcattaactcattggtcgccggtggcccggcagcgaagagcaagtcgattagcgtcggcgatcgtatcgtcggcgtagggcaggccggaaaaccgatggtcgacgtcattggctggcgtcttgacgatgtggtggcgctgatcaaagggccgaaaggcagcaaggtccgactggaaatactgccggctggcaaagggacgaaaacgcgtattatcacgctgacgcgtgaacggattcgtcttgaagatcgcgcggttaaaatgtcggtgaaaaccatcggcaaggaaaaagttggcgtactggatattccaggcttctatgttggcttgaccgatgatgtcaaagttcagcttcagaagctggaaaaacagaatgttaacagcatcgttatcaatctgcgttcaaacggcggtggggcgctgacggaagccgtttcgctttccggcctgtttatcccttctggtccgatagttcaggtgcgcgacaataacggtaaagtgcgtgaggatagcgacaccgacggcgtggtctactacaaaggcccgctggtggtgctggtcgatcgtttcagtgcttcggcatcggaaatcttcgctgccgcgatgcaggattatggtcgcgcgctgattgtcggtgagccgaccttcggtaaagggacggtacagcaatatcgttcgctaaaccgaatttacgatcagatgctccgcccggaatggcctgcgctgggttcggtgcagtacaccattcagaagttttaccgtgtcaacggcggtagtacgcagcgtaaaggggtcacgccggatatcatcatgccgactggcaatgaagagacggaaaccggagaaaaatttgaagataacgccttgccgtgggatagcattgatgcggcgaaatacgtgaaatcggacgatttggccccgtttggcccggaattattgaaagagcacaacgcgcgtatcgccaaagatcctgagtttcagtacatcatgaaggatatcgcacgtttcaatgccatgaaggataagcgcaacatcgtctctctgaattatgcgcagcgtgagaaagagaacaatgaagaagacgctctgcgtctggcgcgtattaacgatcggtttaaacgtgagggtaaaccgttgttgaagaaactggacgatctgccaaaggattaccaggagccggacccgtaccttgatgaaacggtgaagattgctctggacctggcgcatcttgaaaaagaaaaaccagcggagcaagcggcaaccgataagtaacgctaaacaggcacaaaaaattgtgcctgttttttttaacaagcgcagaagtcgtcaggataatgctacaaaatgtaaagttgtgtttttctcgtgacttaccgcctggtgatacttgaaaatagccataagacccatacgatgtgggtaatcgcatagtgcgctttgttaaattgaggttaaaagaaaattatgatgcgaatcgcgctcttcctgctgacgaacctggccgtgatggtcgttttcgggctggttctgagcctgacagggatacagtcgagcagcgtgcaaggcttgctgatcatggcgctgctgtttggttttggcggttcttttatttcattgctgatgtccaaatggatggcgttaaaatccgtaggaggggaagttattgaacagcctcgcaatgaaagagaacgctggttgatgaacaccgtagcaacgcaagcgcgccaggctggtatcgccatgccgcaggttgctatctaccatgcgccggacattaacgcgtttgcgacgggcgcacgccgtgacgcctcattggtcgctgtgagcaccggtctgttgcaaaatatgagccctgacgaggcggaagccgtcattgcgcatgaaatcagccatattgccaatggcgatatggtgacgatgacgttgattcagggggtggttaacaccttcgttatctttatttcgcgcattatcgcgcaaattgctgctggttttctgggcggcaaccgtgatgaaggcgaaggaagtaacggtaatccgctaatctatttcgccgttgcgacggtgctggaactggtcttcggtattctggcaagcattatcaccatgtggttctcccgttaccgtgagtttcatgccgatgcgggatcggcgaagctggtgggccgtgaaaaaatgattgccgcgttgcagcgcctgaaaaccagctacgagccgcaagaagcgaccagcatgatggcgttttgtattaacggtaaatcgaaatcgttaagcgagctgtttatgacgcacccaccgctggataaacgcattgaagcgctgcgtagcggcgagtacctgaaataataagcccactggcaagtatgaaaagcgcgtcgaatgacgcgctttttttacgcctgaacgcgtggttgcgtaatacgtaaaccgctcaccaccgccgcgagagtcgccaggatcgccgccgcgagcagcgaaagatgcgtaccgctatcgccaaactggttcaacatcagcgctaccagcgcggcgccagtactttggcctaacagtcgcgccgtgcccagcatcccgctggcgccaccgctgcgctcacgcggcgcggaagtgataatggtgtgattattcggcgactggaacaggccaaaccctgcgccgcaaaggatcatcggccagataatattcagatcggagggggtgcctggcaacatgaccagcgcaaacaacccggctgccattatcaccattcccagcgcccccagcaaaccggcatgaagacgttctatcaggtatcccgccagcggcgccatcaccatcgttgccagcggccagggcgtcaataacaggccggtttctacttcgctacggcccagcacggtttgcagataaaaaggtagcgagaccatggctaacatttgcgcgcagaacgagcaaattgacgtgccgatcgagagtgaaaaaagcggaatgcgtaacaagtcgatgggtaacaaagggacgggcaaagaaagctggcggcgcacgaagaaaaacccgaccacgaccagaacgagcagctctgcgccaatcaacgttagcgactgtccctgggcaaagccgctcaatgcggtaatcagcagaccaaatgtgagcgcattcattaccgcgctcggtaagtcaaagcgcggcttagtgtcatgggcgatgtttgctggtaaaaagcgtatggccagaattaacgcgatgatacctaacgggacattaatcagaaacagccatttctatgatgagatggacaaaatcgccgcggcgatcgtcggacccgcggcggaagagacggcgacgataaaagagttaattcccatacctcgtcccagatgacgctgggggtagataagacgaatcagcgccgtgtttacgctcattagcgccgcgccgccaaattcctgcgcgatgcgcgccagcgtcagcatctgcagcgagtctgaaagcgcgcaaaacaatgatgaaagcagaaataccactaaaccacatttatagatccggtgataaccaaacatgtcgcctaaaaaagacagggaaagtagtgagacgacaatggcgatttggtacgcattgacaatccagatagagctggcaggggaggcatgtaaatcagtcgcaatggttggcagcgcgacattagcgattgcgccatccagaaccgccatcgaaataccgataataatcgtcaggatagcgccgtatctctgcgggaggggcagccgtcggcccgtgttttttccataagtattttgtaataaggggaattatgagctgaataataatgttagcattaatactgagttgttatgtcgtagatttgtaacgaagtaagcaaagatggattgcgggcgacctggcgtgaaattataataaaaactcgttctgaattttataaaacgctcgtaatgaggtgataaatggcaaacgcagatctggataagcagcctgattctgtatcttctgtgctgaaagttttcggcattctgcaggcgctgggtgaagagcgtgaaatagggattaccgagctatcgcagcgcgtcatgatgtcgaaaagcaccgtttatcgctttttgcaaaccatgaaaacgctgggctacgtggctcaggagggggagtctgaaaaatactctctgacgctaaagctgtttgagctgggcgcgcgagctttgcaaaatgttgatctcatccgcagtgcggacattcagatgcgcgaactgtctcgtctgacaaaagaaactatccatcttggcgcgctggatgaagacagcattgtctatatccataaaattgactctatgtacaatctgcggatgtactcacgtattgggcgtcgtaatccgctgtacagtacggccatcggtaaagtgcttctggcctggcgcgaccgtgatgaggttaagcagattctcgacggcgtagagtataagcaaagcacgggacgcacgattaccagcactgaagcgttgctgccgctgttggatgaagtgcgtgcgcaaggctacggtgaagataacgaagaacaggaagaagggttacgttgtatcggcgtaccggtatttgaccgttttggcgtagtcatcgcagggttaagcatttcgttcccgacgctgcgtttttcagaagaacgcctacaggaatatgtggctatgttacacgtcgccgcgcgtaaaatttctgaacaaatgggttacaacgattatcccttctaagcaacgttattagcatgacgttaaaaaaaagcagctacatttttcgtagctgctttttttataacatcgggtgggatgaaatcgtaaaagtagataatatctgtcggcttatttaacggttattaaaatattatttaacagtacttatgaacaacagccaatataggggaattattggtgatagtttcactgtgaaattatttattgccgcttagccattatccaccacggtggcgatttttctgaaaatgggacagtcggaaaagccgataatgccgctgttggtatggagatattgcgccgtgctggtgccgcgtgcggtcaggtaatggcactgtaaacccagccccgcagcgttcactttacttcccaccaggatgccatagccgctcatcagcaggcctatccacaccagggcaaacaatacaattgcgcgaatgatcaaacgcattactacctcttttttagttagaataagagtagcgtgtacattgattgaaacaagtgaatcattcctaaaaacatataatgccgctacagttactcctggtttaagtaacttatgataatttagcgacataagatgtaagatcggagagtggagtgaaaaaatttcgatgggtcgttctcggcatcgtggtggtagtatgcctgttgctgtgggcgcaggtgtttaatatcatgtgcgatcaggatgtacaatttttcagcggtatttgcgccatcaataaatttattccctggtaaacgttttacaccagagatttccttcccgtgtagcagtggtagaatgacgtctctacattgaggtggtgaaatgaacgacgttttaaactctggtgcgttttctcttgcatctttaatagtatcaatggtggttctggtggtggggctggcgctctggttctttgtcaaccgggcaagttcccgtgccaacgagcagatagaactgctcgaagcgttgttggatcaacagaagcggcaaaacgcgttgttacgccgcctttgcgaagcaaacgaaccagaaaaagaagcggaacccgcaacagcggcaagcgaaccgaaagaggatgaggacatcattcgtctggttgctgaacgataatgcttaccggggcgcaaatggcgccagtgccatacgccccatttccccgtcggatctctccgcgttgccgtttgcaactgatactacagcatcaacaccttacctaatatatggctttatatgcaacatagttttatatgtataacaaatggacatatggcatttttgtgataccgctcattctctattaaaagcgaaacgtttctctctctttatggattgtcattgtttgttcattattttaaggcattctgtaaagacgcagaacatcacaaaaagcggtgtcgaaaatcgcttttcttttctattattttgattaaaaggtgttttttatcattgtgacaatttatgcataactcagcataaaaagtgatatgaaaaatacagcttttaaatgtgatttgatgcactggaagaagcgaaattattgagctatggtagaaaaatggcttttcagcagtgacgttgtcaggagtccgtcagcgcgtgaggatatatctttcgcaattttgttgcataaacgtgttgtcaatttgtgaaggttctcgtaatttgtgcgacggatcgagacacgtttaaaaatggcttgccataattaacgttatatgtgataacaggctttgggttaaacgaggtacagttctgtttatgtgtggcattttcagtaaagaagtcctgagtaaacacgttgacgttgaataccgcttctctgccgaaccttatattagtgcctcaagcagtaatgtctcagttttatctatgttatgcctacgggcaaagaaaacactctaaggaattttgcaaatggcaaagattaaaggtcaagttaagtggttcaacgaatccaaaggttttggcttcattactccggctgacggcagcaaagatgtgttcgtacacttctccgctatccagggcaatggtttcaaaactctggctgaaggccagaacgttgagttcgaaattcaggacggccagaaaggtccggctgctgttaacgtaacagctatctgatcgacaccactgatttgatgcgtttgtcgcgtcagcctcagatataaagcctcgctaaaagcggggctttttaattcaatatccttcaaaatgtgtctggatgcgctctcgttagcgatttgttgcaaaggcgcgatgttattagcattgttttttctggtttttccggccgtttcccgttaaatcaatcacctgaaaaatgattcggctggagatcaggtgaaaaagaaaagcgacggcgatacccgtaattttacacccatacgttttgcactactttgcactgccattctgctcagtatggcattgttgttagggcgggtggcatggctgcaaattgttacgccgtcgaaactggtgaaacaagaagatatgcgctcgcttcgtgaagtgaccacggcctctccacgcggcatgatcaccgacagagaagggcggcccttagcggtgagcgttccggttaatgctgtctgggccgatccgaaaactatcataagcaaaggcggcgttggctacaatgagcgctggcaggcgctggccagcgccttacatctgtctctcagtacgcttgcggaacgggtaaacagtaacccggcaggtcgttttatctacctcgcgcgccaggtttcaccccagcaagccgaatggatagataaactgaatctaccgggtattaacctgcgggaagagtcgcgccgtttttaccctgccggacatgtagcggccaatttgatcggctttaccaatatcgacgggcagggaatagaaggtattgaaaagagctttaacgcgcaactgacgggaaaaccgggctcccggctggtgcgtaaagataaatttggtcacgttattgagaacattacggaagtgaatccggttcctgctcatgaacttcagcttagcattgatgaacgtctgcaaacggttaccgaagatgcgctggataacgccgtcatctggaacaaagcggaatccggcgctgccgtattgattaacatcccaacgggtgaaattctctcgatggcgagctacccggatttcaacccgaacaaccgtgaaggcgcgcagttggacgattttcgtaaccgcgcgattagcgacactttcgaacccggttctactgtgaagccattggtcattatgactgcgttacagcagggtatcgtgcaaccggacagcgttatcgatacccatccttttactctcgatggacaccgtatccgcgacgtcggctactatccggaactgacattaaccggcattttgcaaaaatccagcgataccggcgtttctcacctttctctggcgatgccggtgcagaaattaatggatacttataaaagctttggtttcggcgtgcctaccggactgggtctcaccggagagagcagcgggttattaccgaaacgccgttactggagtgatttagatcgcgctaccttcgcttttggctatggattaatggtgacgccgctgcaactggcgcatgtttatgccacgattggcagctttggtatctaccgtccgttatcgatcaccaaagttgatccgcccgtgatcggcacgcgagtaatgccggaagaactggtgcacgaggtggaacatatgatggagagcgtcgcgttgcctggcggcggcggaacaaaagccgcagtaagagactaccgtattgcggtcaaaaccgggacggcgaaaaaaattggcgatgatggtaaatacgttgataagtatgtggcatataccgcaggcgtcgcgccggcaagtaaccccagatttgcgctggtggtggtgattaataatccacaaaatggggcttattatggcggtgcggtatctgcgcccgtattcagccagatcatgggcgatgtactgcggctggaaaatgttgagccagacggtatgccagccgattcagatcaccttctggtgatgcatggcagccacgttgcggttccgggctcgtaaaggattttcccggggcgcaattcgcgttacacttgcgccctttagcgccccagtccggagttgtcatgtcgtttacctgtccgctttgccatcaaccgcttacgcagattaatagcagcgttatatgtccacagcgccatcagtttgatgtggcgaaagagggctacatcaatctgctgccggtacagcataaacgttcgcgcgatccgggcgacagcgccgaaatgatgcaggcgaggagagcgtttcttgatgcaggccattatcagccgctgcgcgatgcggtgattaacctgttgcgcgagcggctggatcagtcggccacggcgattctggatattggctgcggcgaggggtattacactcatgcttttgccgaggcgttgccgggagttaccacgtttggactggacgttgctaaaacggcgatcaaagcggcggcgaagcgctattcgcaggtgaagttttgtgtggcgtcaagccatcgactgccctttgccgatgcgtcaatggatgcggtgatcagaatctacgctccgtgtaaggcgcaggaattggcgcgtgtggtgaaacctggtggttgggtcgttaccgccacgccggggccgcatcatctgatggaactaaaagggctcatttatgatgaggtgcgtttacatgcgccgtataccgagcagctcgacggattcacattgcagcagagtacccgccttgcttatcacatgcagctcaccgccgaagcggctgtagcactgttgcaaatgacgccatttgcctggcgcgccagaccagacgtgtgggaacaactggctgccagcgccggacttagctgccagacggatttcaaccttcatctctggcagcgtaaccgttaaccgtgaaaatgcgtccagaggatctggacgccaattcctatcagtacgaccccgccgagaatttcagcacgcttacccagcattgggccgataaagcgaccgatcatcattccgagggtggacatgataagcgtggcgcaaccgatagctaatgcggttgcgatgatgtttacctgcaaaaacgccagaccgacgccaaccgccatcgcatcgaggctggtcgcgatagccgtcgtgactaatagccaaaagctgtgacgacgtaacggtgtttcatcttcatcactaccgccgcggataccttcgatgatcatgcgtccgcccagaaagatcagcagaacaaaggctatccagtggttccattccagaacgaatttactcgccaatatccccagcccccagccgatcaacggggttagcgtttcaaccgcgccaaagataagaccggtacgcaacgcttctgagaatttgggtttatgtagggtggcgcctttgccaattgatgccgcgaaagcatccatcgacatgccgaaagcgagaagaacagtagcagtaaagtgcatgacagcgtcctgaccggggtatccattaaacacatcactgcccccagcaaacatgcatgtcgccattctgtgacgaaatacacagcagttgatgcgcctatggtctcgcctgaccagcggcggctggtccgtacgcgccacgttttgcaacgagtatgttgacacgtacatttccggagtctggaaatcggctactccctaattgacggcgcaacattaacatatttttagaatataaaacaacagcgataaaatattatttgccttctaattgaaaacgattttcatttagatttattcatcaataaaacgttaaattaaataacaattggtcaatagaaaatatagccttagctatattatgattcgaaataaaattcgaaaaacatagttgaggctatatcttaagctattgattttcaataagaagtttatatattttttccagatcgtcgatattgcgtacacggataagcaagcgtcgttgttctaattgcatcaccagtacgccgtcctccgataaattcatctctttaatacggttatattctatccagacattggcgaagaaaaagccacgttgtttaaagatgatccgtggcgtgcggatccagaatatataaaaccccattaacgccagcgcgcttaataaccatgtggtcatctgcgctccgtggctggttacgttgttataaataaggatggcgaccagcccaacgaagataacgctgtctatgcgaccgcggcggagcagggctatagaaagcagagtggggccattgcgacggggcatgatgaactgatcgtagagagcgtaagccaataatgcggcaataaagagaatcagcaccaggtccgtgatagtcatttatcctccagagaaataaaaaaacggggccgtttggccccggtagtgtacaacagccttactggcccagcagtcctacggagtagccggcgataccaatgacgaagaagcccacgataatccacagcgggttaactttcttacgcagcagccacatacaggcaaaggtcaacagtagcggaaccagacccggcatcagctggtcgagaatggtttgcacggtggtaacgcgtgtctgaccatcctgaccggtgatggtggagaccaccagcgggatattcacatgcgtccacttgttaaccaatgcccccatgacaaacaggccgaggattgacgccccctcagtcagtttttgcaggaagccgccgcccatatctttaacgatatcgacgcctttgcggtagccataagccacgccataataacgggtcgccagacgcaccaggttaaacaggatgaaaaacagcagcggaccaagcaggctgccgctcattgcaatacctgcgcccagcgccgcgaatactggacggacggtaccccagaagatagggtcgccgacgcctgccagcggtcccatcagaccgactttgataccgttgatagcaccatcgtcaatctctgcgccgttcgcacgcttttcttccattgccagcgttacgcccagtaccggcgccgcaacgtaaggatgagtgttaaagaactccaggtgacgcttaatcgcctgtttacgcgcgtcattattctccggatacaggcgacgaatcgccggcaccatagagaagcagaagcccagcgcttgcatacgttcgaagttccatgacccctggaacaggttagaacgaagaaatacgccgcgaatatcgctcggagtgagttttttctcggtggtagttttagtcatatcaaccatttcgctcacctgttagtccagttcgttatcgagatcgttattgccagcagccgctgcaggcgcgcccgctacacggttgtatttcgggctcagctggatgtaaagaatagccatcactgcgccgatgacacccagtgcgaccaggttgaagtttgtgaaagccgcggtgacgaaaccgaggtagaagaacggcatcaggtagcctgcgcgcatcatgttgataaccatcgcataaccaaccacgacgatcatgccgccggcgatgttcagaccgcctgtgacgacttcaggaatcgcattcagcattccctgtacttcgctggtgcctacggagatggcaacgataaccgccgggatggcgatacgcattgcctgcaggaacagagaagaaacgtgcagccaggagagcgccgtcaggttgccgttttcagccgccttgtccgccgcgtgctggaatgccacggtgatggtacgaacgataatggtcagtacctggcctgccgccgccagcggaatcgccagcgcgataccggcgccaatgctttgatgcccagcgatgaccagaacggtagagatgatggacgccagtgcggcatcaggcgcaacggcagcaccgatgttcatccagcccagagcgatcatttccagagtaccgccgatgataataccggttttcatgtcccccagaacggcgccgattaaggtacaggcgatcagcggacggtggaactgaaattcatcaagtaccgactccatacccgcgatacatgcgacgatgaacaccagcacaatctgaagagtggtaatctccattgtacttctcctattgctatcttaagtgtgaaagctaattaaatgccggcggttatttcgccactttggcaattaaatccatcattttcagtttcggatcggtggaaactttacgcacctcaagctcgatgccgcgctcgttgagctttttaaaggcttcgatatccttttcatcgacggaaacggcgttgttcacctgcgttttaccttgacgataggccataccgccaatgttcacggaggtgactttcacgccgccctcaacgatgcgctcgacgtcggtaggattggtaaacagaagcatcacgcgttcgccggcgtatttcgggttattgtagacgcgaatcatcttcgcgacgtcaaccacatgcgccgtaacgcccggcggcgcaacttgcgtcagcagcgttttacgtacggtatccgccgcgacttcatcgctcacaacaataatacggctgacattggtctctttggtccagcgggtagcgacctgaccgtgaatgaggcggtcatcaatacgggcaagcccgataaccatataatcattcgggcccatcggttttgccggcgtggccgcttttggcgcggcggcgaccggcgctggcgcggctttttctaccggtttcgctttcagcgcttttacgccttcacgaccggtttctaccgccagtgcgaccagctcgtcaaagctcggatcgtcgtcacgagccataaacgtttcgaccagcatcgggatgttgacgccggcaataacttcatagcgctctttatcgacgacaatgcggctggcagcattaaacggactgcctccccatgtatcaacgagaaatagcacgcctttactggtatcgagtttagccaactgagcgttgtacttttcgatcagcgtttcggcattttcgcctggaacgaaatcgatccagccgacgttttcctgctcgcctaacagcatttcggctgttttaagtaactgctctgcagcccaaccatgtgtgcctataacaatagcaatggtcacttgctacctcctttattattgtcaacacatcaacttgacagatgtattttttgaatcgccgtccgcaagcgaatcgattcagatgagggttacaacgaaaaacgcatgattttcgtgaattattttagatatcgaaaaaaatattttgtgtgatggagatctgtaattttgttttcgataatgagaaatttcgaagtgtaaaatatcctggttacatctctttgcaaaggaaggtaaatctttgccaaaaaccagttgtctctgttatgtttagcttccgtttaattagaatggggtatagggcagcagcccgttgtatggatcgtcaccgacgtcatttcactctttggccgttttgcgcctgtcaatctggcatatcttgccatagccttactttgtttattgcgttaccgcctgcatcctttgagatgttgtgggcgccgtttagtcattccttaagcaggagcttgtcatggaattattaatggatccctcaatttgggtgggtttactcacgctcgtcgtcctggaaattgtcctaggtatcgataacctggtctttatcgcgatcctcgccgataaattgccgccaaagcagcgtgacaaagcgcgtcttatcgggctctcgctggcgctgattatgcgtctggcgctgctgtccattatttcgtggctggtgaccttaacaaagtcgctctttactgtctgggattttaccttctccggccgcgatttaattatgctgctgggcggtatattcctgctgtttaaagcgaccaccgagctgcatgaacgtctggaaaaccgcgagcatgacaccggacacggtaaaggctatgcgagcttctgggtggtagtcacgcagattgtcatcctggatgcggtcttctcgctggacgccgtgattacggcggtaggtatggtaaaccatctgccggttatgatggcggcggtggtgattgcgatggcggtgatgctactggcgtcaaaaccgctgacccgttttgtcaaccagcatccgacggtggtggtgctctgtctgagtttcctgctgatgatcggcttgagcctggtggcggaaggatttggtttccatattccgaaaggctacctgtacgcggcaattggtttctcgatcgttatcgaggtgtttaaccagattgcgcgccgcaactttattcgtcatcagtccacgttgccgctgcgcgcgcgtactgcggacgctatcctgcgtctgatgggcggtaaacgtcaggcgagtatgcaacatgagacggatagcccggccgcgatatcggtgtcggaaggcgccttcgccgaagaagaacgctacatgattaacggcgtactgactctggcgtcgcgctccctgcgcggcattatgacgccgcgaggcgaaattagttgggtggatgcgaatctcagcgtagctgaaatccgtcagcagttactctcttctccgcatagcctgttcccggtatgtcggggcgagctggatgaaattatcggtatcgttcgggcgaaagagttgctggtggcgctggaagagggcgcggacgttgcggctatcgccgcctcttccccggcgatagtggtgccggaaacgcttgatcctatcaatctgttaggcgttttgcgtcgcgcgcgcggcagtttcgttatcgtcactaacgagttcggcgtggtgcaggggctggttacgccgctggatgtgctggaagcgattgccggtgagttcccggatgccgatgaaacgccggaaatcgttgccgatgccgagggctggatagtgaagggcggcaccgatcttcatgcgttacagcaggcgctggaagttgaccatctggtgaacgaagagggtgatattgcgacggtcgcggggttagtgatcgccgctaatggccatattcctcgtgtaggcgatgtcattgatgttccgcccctgcggatcaccattgtcgaggccaacgactaccgtgtcgatctggttcgaattgttaaagaacagcctgcccacgacgaagaggaataacgtcacacgcaggaatcaagtctatagatgcggcatcgcggacataatctgtccgttatgccgggcgggcggcggcgcgctgcccgccagccactgtggaaattcgctaatgggcatcggcttcgcatagagatagccctgtaacatttgcacgccatgctggcgcaaatgctgtgcctgcgtctggttttcgaccccttccgcaaccagttcaatattcagtctttgccccagcgcgataataatatcggtcaccgttgaattgaccgcatcggtaccgatgacggcggtgaagaatttatcgattttcaaaatatccggacgcagtttttccagccaggagagcgagctgtttcctgtgccaaaatcatcgatggctaacttcacgcctttacgatgcagctcgcgcatcaggcggtaatcaacgtcaagcaacgcgtcgcgttccgtgagctccagcaccagttgctgaacaggttccgcactaaaccagtactgattaagatccttgagaagcacgccgtgtcggaaatggcttgccgccacattgatgccgatatgaaactgatggttgatggggaagtagtgccgctgccgaatggtttccgcaatcacatagcgggtcagcggcgctatcaggttatgctcctcggtgataggaataaaaacatccggtgagatccagccctggcgcgggttattccagcgtaacaggatctcaacgccggtacactgctgcgtgcgggcattaagcaacggctgacaaaatagctcaaactcccgttcggcaagggccagattaatttcccaggaaaagctcattctgctggcggttgccagccaggcgatataaccgatcaacaggctaagcaatacggccagcggtaactgcgtcgggagatgtttgaacgccagtacgcctgccgacggcccgctgacgctgatagtaaaagggaaatgccgcgatgaaagctggtaacgctcttcatctttttttaattccggaagagtatcgaccacgccccgaccatataacaggtgccgtttgccgaccgtcaggctggcgctggtaatttgcggctgctgcggctcaagtagcatagtcgccagcaagtcaatattcacaatttccatcacgccatcctgtccatcggcagaggcgggataccactgaatgaggatcgggcttcccttgagtaacgattggtccgtggaaagtagcagcagatcgccagctgcgggaagatcgggctgaagctggcgtatgggagtattacgggcgccaaaaatgcttgagcagtagagaattccctcttttaccagcccgatagaacgaatggtttgcaggcgggcggcttgcttacgcaacggcagatgcgcggtcgcgcacggaagctcaagtaagggtagcagtatgtttcgtccgaccaggagaggatgcagcacattatccagcgcatcaacggcatgattcgcgaatgcaaccgtgcgatggtgatttaagttccgctccgaaataaatcggatgttcagcgtaagaatgagcgtgaccagtgcacaaatcgtgcaaacaatgaaacgattacggcgataatgattgatgatccgttgtgctgtttgcatgcgggccgcccaataagcgttggcgacaaaagccaaccgcgacacagcaagtgtagtggggaaacgtggagtcgacgaggaagagataaaaatttcgcccatccgtagcagatgggcgaagggaggggaaatggcgtttaatcacactggactttaatagccaacccgccgcgcgacgtttcgcggtatttggcgttcatgtcttttccggtctcgtacatcgtttcgatgactttatccagcgagacgcgcggcgcgctggttcgacgcatggccatacgcgcagcgttgatcgctttaaccgaagcaatggcgttacgctcgatacacggcacctgcacctgaccggcaaccgggtcgcaggtcagccccaggttatgctccatgccgatttcagcggcaacgcaaacctgttccgggctggcgcccaacagttcagcaaggcctgccgccgccatcgaacaggcgaccccgacttcgccctgacagccgacttccgcgccggaaatagacgcgttcatcttatacagcgcgccaatagcgcctgccgccaggaagtagcgggtgtaaatatccgggctgacagactcaataaaatggtcgtagtaagccagtaccgcaggaacgatgccgcacgcgccgttggttggcgccgtcacgacgcgaccgcctgcggcattctcttcgttcaccgccagagcaaacatgttcacccagtcaatgacgttcatcggatcgctggaaagcttatcgctggaaaccagcatacgacgcagcgcagaggcgcgacgcggtacgcgcagcggccccggcagaacgccttcggtattcataccgcgatcaatacaagcctgcatggtttgccagacgtgaccgaaatactcttcaatctctttcttgctatgcagcgccagttcgttttgcatcaccatgccggagagtgaaaggccggtgctgttgcaatactccagcatttctttcgccgatttaaacggataaggtacagtaacctcattcgtcgcttcctggccgaaatgcgcttcatcaacgataaagccgccgccgatggaatagtacgtcttgctataaatgaccgtgtcgtcatgccaggcgtggatctgcatcccgttttcatgcagcggcaaattgccgttgtgaaaacgcattccgtcatctttcgggaagtcgacttcgtgacgtccctgggccagtaacagacgctcgcgcgtttcgacgtcgcgaataaaaccggggatactatcaatatccacggtagcgggttcattacccgccagacccataataatggcgatatcggtatggtgacctttccccgtcagcgacagcgagccgtagacatcgacagcgacgcgggtaacgttatccagtaatcctttttcgactaggtcatcgacgaactgtttaccggccttcatcgggccaacagtgtgggaagaggagggaccaatccctaccttaaacatgtcgaataggctaatcacgataatactcctgacagggcaaccggggcttccggttacgatgttataactgcgcatagtgtaagagggaacgctggcatcagcttaactattcacatgaattaaactaatgaataaccgcgtttttactaatattgcgacagtaatctcaagtcgtgtcttgcgcgcgtaaagttaagtatatacacgttgcccttcaggctgcctctttgggggaggcgattgttaccgccttgaggcaacgtgaatggcgttgtgtacagtcagggctttacgccgatttgcagcgccagctcacgaagaatgtttgcggtcatgccccagacgaaataatgctcataccaggagagccatacgcggtgcgaattgccgcgacggtaaacatcaagcggatgatatcgacccagttgcaacgcttgcgccagcggcatttcaaacaccgcagacacttcgtcttcactggcgcgccaggggagatttggcggaataatgccgaccaccgaggtgacctgaaaaccggtcacgctgtctaccggcggtaaaacgccaatcacttccacggcttgcggcgggatggcgacttcctcctgcgcttcgcgaagcgctgcggcgataagcgaagcatcggtactgtccacggccccgccgggaaaggcgacctgtccggcgtgtttgcgcaaatgaatagcccgctgggtcaacagcagccccggctgggggcggcgaaccacagggatcagtacggcggcctgacgttgatttaacgtttcatgagtcatctgcgggcgcaaaagctgaaagcgcgataagaaatgatcgagcgtcagacggctggtatccacgtattagttctccagtgggtgcaggatacgattaactttatcaaaagtttcctgatattccgcttcttcgttgctatcggccacgataccgccgccggctgagcaatagagttggccctgcgttgccgtgacggtgcggatagtaatactggtatccatcttgccgcagaaactcagataaccgatgctaccgcaccaggcgttgcgtcgctgcggctccagttcgtcgataatttccattgcccgcactttaggcgcgccggtaatggagccgccggggaaagccgcgcgcagcagatcggtggcatgaagcgagtctggtaaacgggcagtaatggtgctaaccagatggtgaacggcaggaaatggttcgacgacgaacagttccggcactttcaccgaacctggtacggcgacccggccaatgtcgttacgcatcaaatcgacaatcatcaaattttcagcgcgatctttcattgaattagccagtttctgcgcctgctgacgatccgcctgcggatcgttaagccgtggaagcgtacctttgatcgggcgcgtctgaatatgaccgttctccagttggataaaacgctcgggagaaaggctcaatatggcgccgtcatgtaaacgaagaaaggcgctgaacggggcgcgatttgcgcggttaaggcgttcgaaagcctgccattcatcaccctcgtagctcgcctgaaaacgctgggaaagattgacctgatagcagtccccgctgtgcagccaggcctgcacctgacgaaacttctcgccatactcgcaacgcgtcatattggattgccaggccgaggtaagcctgaagggcgttcgggtcggcgcgcgctggccggtgagccagcgatatcgggcgtctgcatcgtgatagcttatcagcgacactacctgtttatggtgatcgacaatcagcgcccagtcgtaaaggccaatcgccatatcgggtaaagcgatatcgcgcgcggcagtatcgggcagaatttcgaaacgccgccctaaatcataaccaaacagacccagcgcgccgccctgaaagggtaagtcagggtcaggctgaggatgaaaaggcagcgcctccagttgagtctgcaaaacgtgtaacggatcgtcgagagtgacggtagtcgtgcgcgcagtacataccgtggtttcctgggcgcgcgtggtcagtgtggtgacaggatcggcgaccagaatatcaaaacggttatagggatgaatagcatcacctgaatgcagcagcatcgcccagggcaaatggtttacgggcgcaaaatagtgttcagcggcgtccggacgccagggtaaggtgataacagtgggagataacgtcttcatcattcctgactcgttacaacactactggcttaccgccgggtagcgtgaaataattagcgctaacaatttagcaggagttaatcatgtttgcaggtttaccttcactcagtcatgaacaacagcaaaaagccgtagaacgtatccaggaattgatgtcgcaaggtatgagtagcggagaagcgattgcccaggtggcaggcgaacttcgcgccaaccataccggcgaacggatagtggcgcgttttgaggatgaagacgaataaccggcttataccgccgcgacaatcttaatctcaactttatatttcgggttcatcaacccggcctgtacggtacagcgtaccggcgcatggcctgcgacgacccacgcatcccacgccttattcatggcggcaaaatccgctttatcgctcaggaaaatagtggcatccagaatacgtgacttactggagccctgtttttccagcaccgcatcaatttgcgccagagtattcgccgtttgctcaaaagcatcggcgtccaggttttccggcacgccgatataccacagcgtattattgtagatcaccacgtctgaccaacgatcttcggcatcaatacgcacgatagacatcacttattcctcatttgctttccatttgaatggctcaagactgccacaatgtggcgccgccgtcacctctgtaactggcgtaagcctttctaccctgacataatcccctgtgcaaattaacagggggcagtgtgacggacgattttgcagcagatggccaactggccaaagcgataaccggctttaaaccgcgcgaaccacagcgacaaatggcggttgccgtgacacaagcgattgaaaatgcgcagcctttggttgttgaagccggcaccggaaccgggaagacctatgcttacctcgctccggcgttgcgcgccgggaaaaaagtcattatttcgaccgggtcgaaagcgttgcaggatcaactctacagccgcgatctgccgacggtagcaaaagcgttggcgtttaccggtaagacggccctgttgaaaggacgttcaaactacctctgcctggagcgtctggaacaacaagcgctggcgggcggcgatttaccggtacaaacgttaagcgacgtgatattgctgcgctcctggtcaaatcagacgcgggatggcgatatcagcacctgcgtcagcgtggcggaggattcccaggcctggccgctggtcaccagtaccaacgacaactgccttggcagcgattgtccgctttacaaagagtgctttgtggtgaaagcgcgtaaaaaggcgatggacgcggatgtggtgattgtaaaccaccacctttttcttgcggatatggtggttaaagagagcgggtttggcgaacttatccctcaggctgaagtaatgatcttcgatgaagcccaccaactgcctgacatcgccagccagtatttcggacaatcgctctctagccgtcagttgctggatttagcaaaagacatcaccatcgcctaccggacggaactgaaagacactcaacagttgcaaaaatgcgccgatcgccttgcccagagcgcccaggattttcgtctgcaactgggggagcccggctaccggggaaatttgcgtgaactgttagccgactctcgtatccaacgggcatttttactgctggatgatacgctggagctttgttacgacgtggcgaaactgtcgctgggccgttcggcgctgctggatgcggcttttgaacgcgccacgctataccgttcacggctgaaacgcttaaaagagatcaatcagccgggatacagctactggtatgagtgcacctcgcgccatttcactctggcgctgacgccgctcaccgtggcggacaaattcaaagaggtgatggaacagaagcccggtagctggatttttacctcggccacgttgtcggtaaatgatgatctccaccactttaccgcccgtctgggaattgaacaggcagaatccatgctgttgcccagcccattcgactatacgcgccaggcgttactctgcgtaccgcgtaacctaccgcaaaccaaccagcccggcgcggcgcgacagttggcggctatgctcaggccgattatcgaagccaataacgggcgatgttttatgctgtgcacctcacacgccatgatgcgcgatctggcggagcagtttcgcgccaccatgacgctgccggtattgttgcaaggggaaaccagtaaaggccaactgttacagcaatttgttagcgccggcaacgcgctgctcgtcgccaccagcagcttctgggaaggggtggacgtgcgcggcgatacgttatctttggtgattatcgacaaattgccgtttacttccccggacgacccgctgttaaaagcgcgaatggaagactgtcgtttgcgcggtggcgatccgtttgatgaggttcaactgcccgatgcggtgattacgctgaagcagggagtggggcggctaattcgcgatgcggacgatcgcggggtgttagtgatttgtgataaccggctggtgatgcggccctatggcgccacgtttctcgccagcctgcctcctgcgccgcgcacgcgtgatatcgcccgtgccgttcgctttcttgcgattccatccgccgagtaatttgttacggagtatggtaagatgcgcgctattttattgatctaagcacgaaacctcatgcgaattctggctatcgataccgccacagaggcctgttctgtcgccctgtggaacaacggtactatcaatgctcactttgagctttgtccacgagaacacactcaacgtatcctgcccatggtgcaggagattctggccgccagcggcgcctcgctcaatgagatagatgcgctggcgtttgggcgcggtccgggcagctttaccggcgtgcgtatcggcattgggattgcgcaagggctggcgttaggggcaaatctgccgatgatcggtgtttcgacgcttgccacgatggcgcagggcgcatggcgtaaaactggcgcgacccgcgtactcgccgcgattgacgcgcggatgggcgaagtgtactgggcggaataccagcgtgatgcgcagggcgtctggcagggcgaagagacggaagcggtgctgaaaccggaacgggtcggcgagcggttgaaacagctttccggcgagtgggcgaccgtaggaacgggttggtccgcatggcccgatctggcgaaggagtgcggcctgacgcttcatgatggggaggtgtcgctcccggcagcggaagatatgttgcccatcgccagtcaaaagctggcggcaggagagaccgttgccgtggaacatgccgagccggtttatttgcgtaacgaagtggcgtggaagaaacttcccggcaaagaatgactctcactactattacccccatactttatgctgtggggtggaatagaggtcgagaaaaaggagtcgcatcatggcggttcaaaaacggttaataaaaggggcgctggcgtgcgcttttgcgcttatgctgagcggttgcgtgactatcccggatgccattaaaggttcgagtccgacgccgcagcaggatttggtgcgggtgatgaatgcgccgcagctctatatcgggcaagaggcgcgttttggcggcaaagttgtggcggtacaaaatcagcagggaaaaacccggcttgaaatcgcgaccgtaccgctcgacagcggcgcgcgtcctgttctgggcgaagcctcgcgcggcagaatttttgccgatgtgaacggttttctggacccggtggacttccgtggccagttagttaccgttgtcggcccgataaccggcacggttgacggtaaaatcggcaatacgccgtataaatttatgctgatgcaggctaccggctataaacgctggcatcttgttcagcaggtcgtcatgcctccacagccgatcgatccgtggttttacggcggacgcgcctggccttatggatatggcggttggggatggtataaccctggacccgcagaggttcagacgatagtaacagagtaaccctttgttttatcaataaaagaaacagcggctggtccgctgtttctgcattcatagagacataataaaaataaatagtgacgcgcttcgcaacctttcagttgcgtaattaataaactggtacgctgagttaatataatgttaacgacttgtttattgactggggttgtgatgacgacgaacactcattttagaggtgatgcattgaagaaggtttggcttaaccgttatcctgctgatgttccggcggagatcaaccctgaccgttatcaatccctggttgaactgtttgaacatgcggcgacgcgctatgccgatcagcctgcgttcgtcaatatgggggaggtaatgaccttccgtaaattagaagaacgtagtcgggcatttgcggcttatttacaacaagggctgggactcaaaaaaggcgaccgtgtggcgctgatgatgccaaacctgttgcagtatcctgtcgcgctatttggtattttacgcgccggcatgattgtggtgaacgttaacccgctttacacgccgcgcgaacttgagcatcagcttaacgatagcggcgcggcggcaatcattattgtttctaactttgcccatacgctggaaaaagtggtcgagaaaacgtcggtacagcacgttattctgacgcggatgggcgaccagctttctaccgccaaaggtacggttgttaactttgtcgtgaaatacatcaagcgtctggtgccaaaataccacttgccagatgcgatctcgtttcgcagcgcgctacagcatggctaccgtatgcagtatgtcaaacccgaggttgtcgctgaagatctggctttcctgcaatatactggcggtacgacgggcgtggcgaaaggcgcgatgttgacccaccgcaatatgctggcgaatctggagcaggtgaaagcgacctatgggccgctgctgcacccggggaaagagctggtagtgaccgcgctgccgctgtatcacatttttgccttaaccatgaactgtctgctttttatcgagctgggtgggcaaaacctgctgattaccaatccgcgtgatatccccggtctggtcaaggagctggcgaaatatccatttacggcgatgactggcgttaatacgctattcaacgccctgctcaataataaagagtttcaacagctggatttttcttcgctgcatctgtcagccggcggcgggatgccggtgcaaaacgtcgttgcggaacgttgggtaaagctgaccgggcaatacctgctggaaggctacgggctgaccgagtgcgccccgctggtgagcgtcaacccgcatgatattgattatcacagcggcagtatcggcctgccagtaccgtcaacagaagccaaactggtggatgacgatgacaacgaagtcgcgccgggtgaggccggagagctttgcgtgaaaggcccgcaggttatgctgggatactggcagcgtcctgacgcgacggatgaaatcattaaagatggctggctgcatacgggcgatattgcggttatggatgaagacggctttctgcggattgtcgatcgtaagaaagatatgattctggtttctggtttcaacgtttatccaaacgaaattgaagatgtggtgatgcagcattctggcgtgcaggaagtcgcggcggttggcgtgccttccggtagtagcggcgaagcggtgaagctttttgtggttaagaaagatccggcattgactgacgatgcgttgatcaccttctgccgtcgccatctgaccggatataaggtgcccaaacaggtcgagtttcgcgaggaattaccaaaatctaacgttgggaaaattttacgacgagaactgcgtgacgaagcccgtggcaaagtagacaataaagcctgagcgttaagtcagctaacgagagacgccggttaagccggcgttttttttggcgcgaaccaaagagaacacgatttgaattaccaaatgattgaaacggacgatgcgctggcgagcctgtgtgaggctgtccgcgcatgtccggctattgctttagatacggaatttgtccgtacccgcacctattacccgcagttaggattgatccagttatttgacggggcaaatgtcgccctgatcgatccgctcggcatcagcgactggtcgccgttaaaagcggtgttgcgcgatacgggaatcaccaaatttctgcacgcgggtagcgaagatctggaagtatttctgaatgcgtttggcgaactgccggaacctctgattgatacgcaaattctggcggcgttttgcgggcgtccgctgtcgtggggttttgcgtcgatggtagaagagtatacgggcgtggcgctggacaaaagcgagtctcgtaccgactggttagcccggcctttaagcgaacgtcagtgtgaatacgcggcggcggatgtctggtatctgttaccgatcgccaaaaagctgatgattgaaactgaagccgcaggatggctgcctgccgcgcttgatgaatgccgattgatgcagcagcgtcgtcaggagattcaggcgccggaagaagcatggcgggatatcaccaatgcctggcaactgcgtactcgccagttagcctgtctgcaacttttagctgactggcggctacgtaaggcgcgtgagcgcgatatggcggtgaactttgttgtgcgtgaagaaaacctgtgggcggtcgcgcgttatatgccgggcagtctcggtgagctggatagcctggggctttccggcagcgagattcgttttcacggcaagacgttgatatcgctggtggcgaaagcacaggcgctaccggaagaggcattgccggaacccctgttgaatctgatggacatgccgggctatcgcaaagcgtttaaggccatcaaagcgctagtggcggaggtgagcgcgtcgcatcacgtcagcggcgagctactggcatcgcgtcggcagattaatcagttgcttaactggcactggaaattaaaaccgcaaaatgggcaaccggaattgatttccggctggcgcgccgaactgatggcggagaagttaactcttctgttgcaggagtattcgctttaacgacggtaattgccgggaaaacggccagtgaaataaatgtccgtattcggaataatgtaaaaaaataaaaaaggcagattcttctgccttttttaatccaggaattttcccataaaagagcttattttgactcttcggcttccggcagcgttacgttaagttcaaggatggagatatcaccatctttttgctcaagctggacggtaaccatttccggatcgatttgtacgtatttacaaatgacctcaagaatatctttacgtaactgcggtaaataatgcggttcggcatcgctacggcgacgttccgcgacaatgatttgcaaccgctcttttgcaatattagcggtactctttttccgcgagagaaaaaaatccagtaatgccataatttatcctccgaacaggcgtttgaggaaacctttcttctcttcttcaatgaagcggaaaggacgttcttctcccaacagacgatctacggtatctgcataggctttacccgcatccgcagtggcgtcaagaatcaccggttcgccctggttcgatgcgcgcagtacggattgatcttccgggatcacaccgacgagtttaatacgcagaatctccagtacatcttccatgctgagcatgtcgcctttattgacgcggcctggattgtagcgcgtcaacaggagatattctttaatcggttcttcgccattttctgcgcgacgagatttcgatgccagaatacccagaatacggtccgagtcacggacagaagagacttccgggttggtcgtgatgatcgcttcatcggcaaaatagagcgccatcagcgccccggtttcgatacccgccggcgagtcgcaaacaatgaactcaaagtccattgctttcagtgagtccagtaccttagcgacgccttcgcgcgttagcgcgtctttatcccgggtctgcgacgccggaagaatgaagagattttcagtacgcttatctttgatcagcgcctgattcagtgtcgcatcgccctgaatgacgtttacaaaatcgtaaacgacacgacgttcgcaccccataatcagatcgaggttacgcagtccgatatcaaaatcaatgacgacagttttctttcccttctgggccaaacctgtagcgatggccgcgctggaggtggtcttgccaacgccccctttacccgaagtaacaacaataatgcgtgccataaaaattccttgttaaaaagggatcaattcaacggttgaactgtcaaagcgttgtctgctaaacgcaggcgcgccgctttgccataaaattctgccgggattttatcactcagccagtaaacacctgcgatagagaccagttctgccgtcagatgggtacaaaaaatttgcgcttcccgatcgccgctcgcccctgccagcgcgcgacctctcatcatgccatagacatggatattgccgtcagcgataagctctgcgccagcgctgacgtgacttgtaacaatcagatcacattgtggagcataaatgcgctgaccggaacgaaccggaacatcaattaatcgcgtttttgtgatgggattagcgttttgcggcggttcgctgggcgttgccggctcaacgggcgcaggccgaaccgctttctctttaccttcagtcagtaaaggaagacccatccgatcgatttctactttcaggctggcgtctttacagccgctcacgccgataatgcgtaagccggttgaggtcacgatcttatgcagttccggccagtttaccgggctttcaagaccgctaacgttaataacgacaggggcgtgttttaaaaacgcaggagcctgcgctattttgtcttctaacgcctgacgaataacctctggttccgcttcatgcaaatgaaccactgataaggtgaagctactgcctttaagctcgattggcgtgtttgacatcctggccttactcaatttgctatttatcatctccgatacggagtgatattccgaagtccagaaggcatgttatagtcagtattatattgaggcaagtcaccatcccgttaattcagagtaaaagtatgttttgtgtgatctatagaagtagcaagcgcgatcaaacctatttgtatgtcgaaaaaaaagacgatttttcgcgggtgcctgacgcgttgatgaaaggattcggtcagccgcagttagcgatgatgctgccgcttgatggacgtaaaaaattagtcaatgccgagctcgaaaaagtaaaacaggcgttaagcgagcagggctattatttacaattgccgccgccgccggaagatttgctgaaacaacatctttcttcggtgggacaaaatacgtcgcacgctgaccgttaaacggtattcggcgccgcgcctgaattccatcatgatcttaggggaaaatatgtatcaacatcgtaactggcaaggtgccttgcttgattacccggtaagtaaggtggtctgcgtgggcagtaattacgcaaatcacatcaaggagatgggcagcgcgacgccggaagaacccgtgctttttatcaagccggaaaccgcattgtgtgatattcgccagccgctggcgattccggcggatatgggcgctgttcatcatgaagttgagcttgccgtgctgattggcgcaacgctccgccaggcgaccgaagatcatgtacgtaaagcgatagccggttatggcgtggcgcttgatttaaccctgcgcgatattcaagggaaaatgaaaaaggccggacagccttgggaaaaagccaaaggtttcgataacgcatgtccgatttcaggcttcatccctgtcgcggccttctgcggcgatccgcaaaatacggttatcggacttaacgttaatggcgaggttcgccagcaagggtcgaccgcggatatgattcatcctattgtgccccttatcgcctatatgagccgctattttacgctcaaagccggggacgtggtgctaaccggcacgccggcaggcgtggggccattattaagcggcgatgagctggacattcgttttaatggcgaaacgttgtctactcgcgttctgtaaaatctgcttgccgccttcagcggcggtaaaacttgcatctgcaggccagactggttataaggtgcagctttaatgcaatggcggatactttaatgagcgatacacctttctggcaacgtaaaaccctggatgaaatgaccgatgccgagtgggagtcgctgtgcgatggctgcggtcaatgctgcctgcataagctgatggatgaagatacagatgaaatctacttcaccaacgtggcgtgcaggcaattaaatatcaaaacgtgccagtgccgtcattatgaacgccgttttgaatttgaacccgactgtatcaaactcactcgcgaaaacttgccagactttgaatggttgccgatgacctgcgcctaccgtttgttggcggaaggtaagcccttgccgacgtggcatccgctgcagactggatcgaaagccgctatgcatggcgagcgaatttctgtccgtcatatcgcggttaaagaatccgaagtacgggactggcaggatcatattttaaataaaccgtcgtgggcagaataagtcttcggcaaaacggctgattgtttacaattctttaatttacgctgggcggcccctgaaatcaggaattgcgtgcaaattccgtcacctggcgttatcactgccttctattcttccctgacgcgccttgtcgctgcgctcgcgcacgtatggcggcgactctatactttcaaagcagtatatcgctgcctatcctgaggagttaccccatgaataaccaaccgttgcgcgtttcaaaggatcagcccaggaagcctgataagacacccgaagacgaaggaaaaaatccaaagaaaaaccaaaagtagtgctgtagggtatctttaataactatggttcgttggaggctttatgtctgaacgtcctgatttagtcgatccattaccagaggatgagccgcttcctggtgaaaatattccggatacgccagagggagacgatcctctcgacccggatacccagaatgaggttgaagatcctcgtagatagcgtcttgtgctattaaccaaccgcctgatgcaccgtctgtgccaggcggttttttgcatcttctaaagcgaaacatcctgataatcctcagaaagatagcctataattttttgtacgttaaaatagtagcgcgtccatgacgacactgtcttattgcgcttagccgtttgcgagttcaaaggaggaaatcaatgaacagcgaagagttgacacataaagcagaagaggaaatcgcggcactcattagcaaaaaggtcgccgaactacggaagaaaaccgggcaagaggtttccgaaatagagttcgcgccgcgagaaacgatgaaagggcttgagggataccacgttaaaattaaactactctagcgtttaattagcgccattaatcacctggctactgggcgggacgccgcccagtggtaactggtttaccgatgtcaggcttttttctgttgatacatttcctcgccctgatggtcttcctctacccaaaaatgaatgttgaaccgcgcatcatcgctcagctctacccgatgccagtattgcggcggactggtggcgaattgcccggcattaatcaccactttcacttctggttctgtcgcggtttcattcgcaaagccatagtaggtcacggtgccttccatcacgcagagttgtccgaaaacgcctgccgctgtgttgtgatgagagagcagtgccgccggaacattctctttggtgtaaaagggggtagagcgtttaactttccagtttgccgggatgcgtaagtgggacataagacatctccctgatgtggtgattaaaagatgtatttaatatacaccttttaatcactggcaaacaacgcttcgggcaaaaaaacgctcccgaaggagcgtgtgtatcaacgaccgaacaggtcgcgttttttaggcttaaatgcctgagctatgacgacagctatcgctaccacaaggtaagcggcaaagatccccaacagccattgcggcatctccagcgttaaaaacgaccactggcgctcggcgcaatcaccggatgccacaaacacctgcggtagccatttacccaacggtaaccagtctggaaagcgcgccataaagtcacaggtcatgaacggcgagggatgcaactgaatcatcgtatgttcatacgccagttgtagaccccgccaggcgctgtaaatccagataaccattgccacgtatcgcagcggcgttttcggcgctattgcgccgaccagacccgcgcccatcacgccaaacagggcgcaacgttcgtaaatacatagcacgcaaggtttaagtaacatgacgtgctggaaccacagcgccaccatttccagcgccagggcggtaaacgccatcagtaaccatgcgccccgaccccgtgagcactggtttaaaaatcgcaacataataatttccctgcaacatgcgtagagaccgcagtgtaaaccaattcaattcgtgcgccactagcgggaaatgaaataatgtgtaattggataattatcaggcaaaaatcggagccgggcggtgtattgcccggccaaacgttacgaaagcgttgctaaccatcctgcctgagtcatccattcggtggccggcgcaagagtgaattcgacgcacagtagccctatcagggtcagtacgatagtgtacggtaacgccatccagaccatacggccataggagagacggattaacggcgccagcgcggaggtcagcaggaataagaatgccgcctgaccatttggcgtcgctaccgatggcaggttagtaccggtattgatggccacagctagcagctcaaactgttttaagctgattgcgccgttttccattgccgccttcgcttcgttgatataaatggtgccgacaaagacgttatctgagatggaagacaacaggccgttaaagagatagaacagcgttagctgtgcgtgttcagaggcttgcaagacgaactgaataatcggcgcgaaaagatgttgatcgataataaccgccacaatagagaagaaaacggttaacagcgcagtaaacggcagcgactcggtaaacgctttgccgatggcgtgttcatcggtgacacccgttaacgcggtggccagaataatgaccgacagaccaatcagtcccacctccgcgagatggagggcgagggcggtaaccagccagacgccaataaccgcctggactattagtttaattttatcctggcgggtgcgcttcttacggctttgatcgtcgaattgctgcaagacgtcgcggactttttcgggcaacgtttcgccatagccaaaccagcgcattttctcgaccagcatacaggttaacagtccacataccagtaccgggacggtgacaggcgacatccgcaaaaagaagtcgccgaaatgccagccagcagctttagcgatgatcaggttttgcggctccccgaccatggtcatgacgccgcccagcgccgtccccacgcctgcatgcatcatcagactacgcaagaatccgcggaattgctccagcaccgttttgtaatgcggatcgatatggctgtcgtccagcatatcgttctcttcgccgcgcgatgaggccacacgatggtaaatcccgtaaaaaccgacggcgacgctgatcaccaccgcaacgacggtaagcgcgtcaaggaaagccgacaagaatgcggcggcgacgcaaaaggccagcgacagaaccatcttcgagcggatactgagtaacagacgggtaaaaataaacagcaataactgcttcataaagtagatgcctgccaccataaacatcagcagcagcaagacttccaggttggcggcaacctcttcacgtacatgggcggcgctggtcatgccgatgataacggcttcaatggccagtaacccgccgggcagcagggggtaacactttaacgccatcgccagggtgaagataaactctgccaccagcagccaaccagcaacaaagggattagctaagaaaatgaatgggttaacaattaaaaagacaagtagtgccagtttgtaccagtcgggcgactggcctaaaaagttgcgccacatggcgcgaccccatgagatctccatgaaatttttccttacctagaaaaatgaaatagcgtttttatgtttaaacacagagagtagcgagcgcgacgaatgcaagcaagtccttaacgatattggcaggcgatatcagaaatggtgccttgatcccctttttcttcattgcgtccgctatcaggtgttacgcccgtctggtatgatgagtacaactatgttttgctgtgtaatggaaatctcactatggtcattaaggcgcagagccccgcgggtttcgcggaagagtatattattgaaagtatctggaataactgctttcctcctggcacgatcttaccggcagaacgagaactctccgaactgatcggcgtgacgcgcacgacattacgcgaggtgttacagcggctggcgcgagatggctggctgaccattcagcatggcaaaccgacaaaggttaataatttttgggaaacgtcagggctgaatatccttgaaacgctggcccgccttgatcatgaaagcgttccgcaactgatcgacaatttgttgtcggtgcgtaccaatatttctactatctttattcgtaccgcattgcgtcaacacccggataaggcgcaggaagtgctggccactgcccacgaagtggccgaccatgccgatgcattcgccgatctggactataacatctttcgtggtctggcatttgcctccggcaatcctatttacggcttgatcctgaacggcatgaaagggttatacacccgcattggtcgccactatttcgccaatccggaagcgcgcagtctggcactgggtttctatcataaattatcgtcgttatgcgagcagggcgcgcacgaccaggtgtatgaaacggtgcggcgttatgggcatgacagcggcgagatttggcatcggatgcagaaaaatctgcccggcgatttagcgattcagggacgataatcccgcgatgcccggtagacgcaaacactaccgggcagcatctcgattacagcgtgttcatgcgcggcggacaacgctccagcagttctacgctgccatcctcattttgttgctccagcatcacatcaaagccccataaccgatgcacatgtttcagcacctctttgcggcctttatccagcggcgcgcggttatgcgggatataacgcaacgtcagcgatctgtcgccgcgtaaatccacattccagacctgaatattcggctccaggttgctcaggttatactgtgacgacagttttgatcgaatctcccgataaccttcttcgttatgaatggcggagatctccagataattatgcctgtcatcatcaagtaccgtgaagaaacggaaatcacgcatcacttttggcgacaggaactgactgataaagctttcatctttaaaatcgcgcatggcgaagtgcagcgtttccagccagtcggaaccggcaatatccggaaaccagtatttatcttcatccgtgggcgactgacaaatacgtttgatatcctggaacatggcaaagccgagcgcataggggttaattccgctataccaggggctattatagggcggctgaaatacgacattggtatggctgtgtaaaaactccagcataaagcgttccgtcactttgccttcatcatacagatggttcaggatggtgtagtgccagaaggtcgcccagccctcgttcatgacctgcgtctgtttctgcggataaaaatactggctgactttacgcacgatgcgcagaatttcgcgctgccacggctcgagcaacggggcgtttttctccataaaatagagtaggttttcctgcggttcagcaggaaagcggcgtgcttcggcgacagttttttcttcctcgcgttttggcagcgtgcgccacagcatattcacctggctttgtagatactcttcccggcttttttgtcgcgctttctcttcctgcaacgagattttctgcgggcgcttatagcgatcgacgccgtaattcatcagcgcgtggcaggagtcgagcagtttttctacttcatccactccgtagcgttcttcacagcgggtaatgtaattccgggcgaaaatcaggtaatcgacgatagagctggcatccgtccagctccggaagagataattatttttaaaaaaggagttgtggccgtaacaggcgtgcgccatgaccagcgcctgcatggtgatggtgttctcttccatcaggtaggcaatgcagggattagagttgatcacaatttcataagccagtccttgttgaccatgcttatacagacgttccgtctcaatgaactttttgccaaacgaccagtgcggatagttgatcggcatcccgacgctggagtaggcgtccatcatctgttcggaagtgatgacttcaatttggtgcgggtaagtatccagttggtagagtttcgccacgcggtctatctctgccagataaacatccagcagatcaaatgtccagtcggggccatcgctcaaacgtgtggtgtccttgttcatggaatcaatcattgccattcgcgcaccctcattgttggcgacgctctctgtatggagcgcctcctttcaagcatagaacaccatgttaaaaaacgacttgatcgtgaaaacttttctttgcgatttcctccacattgaacggcaaaaaatcgggtattggcatcattttatgctgtatagccatgccgcgtagcaggagatcccaaaccaatgggatcgcttgtctttagggtatatgtgaagcacgtcaccataaaaaagtcatatgttgaataatattttcatctgagttatcaagatgtaatcagaagattgttcttttactattaacggagtggctatgcgagttgtcatcctggggagtggcgtagttggcgtgaccagcgcctggtacttgagtcaggcggggcatgatgtcaccgtcatcgatcgcgaatccggcccggcgcaagaaaccagcgcggcgaatgccggacaaatttcaccgggatatgcggcaccctgggcggcccctggcgtaccgctgaaggcgataaaatggatgttccagcgccatgcgccgctggcggtgcgtctggatggcaccccatttcaactgaagtggatgtggcaaatgctgcgtaactgcgatacccggcattatatggaaaataaaggccgcatggtgcgtctggcggaatatagtcgcgactgcctgaaaacgctacgcgccgcgaccggtatcgaatatgaaggccgccaggggggaacgctacaactcttccgcaccgcgcaacagtatgagaacgccacccgtgatatcgccgtgctggaagatgccggggtgccgtatcagctcctggaagccagccgactggcggaagttgaacccgctctggctgaggttgcgcataaattaaccggcgggctgcgcttaccgaatgatgaaaccggggactgtcagctctttacccagcgtctggcgcgcatggcggagcaggcgggcgtaacctttcgctttaatactcccgtggaaaaattactgtacgaaaatgatcagatttacggcgtgaaatgcgccgatgagatcattaaagcagatgcgtatgtcatggcgtttggatcgtattcgacggcgatgcttaaaggcattgttgatatcccggtgtatccgctgaaaggctattcattaaccatcccaatcgtcgagccagacggcgcgccggtatcgacgattcttgatgaaacctacaaaatcgctattacgcgttttgataagcgtattcgcgtggggggaatggcggaaatcgtgggctttaataccgacttactgcaaccgcgccgcgagacgctggagatggttgtgcgcgatctttttccgcgcggcggtcatattgagcaggccacattctggaccggcctgcgccccatgacgccggacggcacgccggtagtaggacgcacccgttataaaaatctgtggcttaatactggacacggcaccttaggctggacgatggcctgcggttcaggccagttgttaagcgatatcttgttgggtcgtacgccagcgataccctacgacgatctgagcgtggcgcgataccgttccgattttacgcccacccgcccgcaacgtttgcatagcgcgcataactgataaaggaagtgaaatgacccgccctatacaggccagccttgatttacaggtaatgaaacaaaatttggctattgtgcgccgggcggccccggaggcgcgcgtctggtcggtagtgaaagccaacgcctacggccacggtattgaacgcgtctggagcgcgctgggcgccacagatggtttcgctatgctcaaccttgaagaggcgattaccctgcgtgagcgcgggtggaaagggccgatattgatgctggaggggtttttccatgcgcaagacctggaggcgtatgacacttatcggctgaccacctgcatccacagtaactggcagttgaaagcgctgcaaaatgcgcggcttaacgcgccgctggatatctatgtcaaagtcaacagcggtatgaaccgactcggttttcagcctgagcgggcgcagaccgtctggcagcaattgcgggcaatgcgcaatgtcggtgaaatgaccctgatgtcacattttgctcaggccgatcatccggaaggtatcggggaggcgatgagacgtattgcgctggcgacagaaggcctgcagtgtgcatactcgttatcaaattcggcagcgacgctgtggcatccccaggcgcattatgactgggtcaggccgggcattattttgtacggcgcgtcgccgtcaggacagtggcgggatattgccgataccggactaaaacccgtgatgacgctgagtagcgaaattattggcgtgcagacgctgagcgcgggtgaaagagtaggctatggcggagggtattctgtgactcaggaacaacgcattggcatcgtcgcggcgggttatgccgatggctatccacgccatgcgccgaccgggacgcccgtgctggtggacggtatccgtaccagaacagtaggcaccgtttcaatggatatgctggcggtggatttgacgccgtgtccgcaggcgggaatcggcacgccggttgaattatggggcaaagaaattaaggtcgatgatgtcgcctctgcggcaggcacgctgggctatgggctactgtgcgccgtagcgccgcgcgtgccgtttgtgacaacgtaacctaactcaggctaaggcgtcgaccggtccaccgggggcgggtcgacgttgtccggcgaccttattctgcttcgtcttcggcgacgcgtaccccaatcttgcgtaccacgttatcttctttttcagctaccgtccaaatcatgccgccaaactccacctgatcgccaacgaccggcgcagcgcccagcagctgctgtatgatttcaccgagggtttgttgtttatcccggtattccgttccttcttccagcccgtagataagcgccacgtcggcgaatttcgcgttcgcttcgaggataaaatcgccaaagaaacgctgatctaacgaaaccggcggcgactggctaaacaatttgcccagcgctggcagatcgcgctcccggccaatcacgcagagtacgtcgccttcctgcaggcgagtgctacccgtggggtgaaacagttcattattgcgaaatagcgcggcaatgcgggtttcgttcggcatatgcaggtcgcgcaacgccgcgccgacgcaccatttgtcggcgctcaactgatagatgaattgttcccacggattatcaggatggatgtcaagccccacgcgcgatactggccagccaaccggaggcacgaccactttggctctcttcgccgcccatgacagcgatgttccctgcaggagcagcgacaccagtaccacaaagaaagcgacattaaagaacaggcgagcgttttcaagcccggccatcatcgggaaaacggcgagaataatcggcaccgcgccgcgcagtccgacccaactgatgaaaatgcgctcccgaagattgaagccgcgaaaaggcagcaggccggtaaataccgacaatgggcgggcgaagaaaatcatccagatagagagaataagcgcagggacggcaatcggccacagatcggaaggcgtcaccagcagtcccaggaccaggaacatggcgatctgcgccagccaggccagtccgtcaaagttttgcaggatgccgtaacggttgcgaatcggacggtttcctaacaggaatccgcacagatagaccgcgagaatgccgctgccttcaagcgcggtcgtcaaagcaaaaatcagaataccgccgctgagcgccagcatcggatacaggccgctgggcagagaaatacggttgatcatctgctgtagcaggtaaccgccgccgaggccaaaaacaataccgagaccgaactgctggataatatggacggcaaacatccagtccaggccggtttcatgtttctggatcatctcaattaatgtaatggtcaaaaaaacggccatcgggtcgttacttcccgattcgatctccagcgtggagcctacacgttcgtttagccctttgccgccaagcagagaaaagaccgctgcggcgtcagtggaaccgactatcgcgccgataagcagaccttcgataagatccagatgaaacagccaggcggccatcatacctgttaaccccgacgtgatcagtacgccgagcgtcgccagcgacagcgcggggcccagcgctacccggaaagagctggcctgggtgcgcatgccgccatcgagtaaaataatcgccagcgccaggttactgaccatataagcgaaaggataattatcgaaaggaataccgccaatgccatccacacccgctaacatcccaatggcgaggaaaatgaccagaatcgggatacccagtcgcgatgagaatgaacttaacaggatactgctggttacaaggatggaacctaaaataaatagactaataattgttgcagcatccaacgttttatatctcctgactcacacgacttcgtattatttaacattaacataataacggccagggcagcgttttacttagcctgtcggggactttttttacaattgcagcgtaggatgaccagataaagtgagttgagtcccctggcgcgtatttttaagcgttgcgtttgccccgatagggagcgtcaccgtacgctgttcatgcccgaagtcgagaccggtaatcagcggaacggacagacgggaacgtaaaaacgcgtagacgctctccagagaatagccggcgtcatactcgttgggcgccgcgccgctaaagctgccgagaacgatggcgctctgacggtttagaattccggcgtactccagttgcaaaagcatacgctccacccggaaaggatgctcattgacatcttccagcactaaaattcctttatcgatagtcggcatccagggcgtaccgataagggaaatcaacatcgccagatttccgccccataaggtgccctgtacgtcgcactgagggccgtcgccttgccactctacggtaaattgcgccttgcgtagcgccagccagaaatgttgctcggtgaacgtattcagcgtttcggcgccaaaatttgccgccagcataggaccgctaaaggtgatgacattggcctgcgccagtagtccagcctgaatcgccgtaaaatcgctatgaccgcaaatcagtaagggatcgcgctgttgccgggaggcgagcgcctgccagtcgatacgatccagcaagcggctggcgccatagccgccgcgaaccggcatgacgatcgtatccggcgaagttagcgaggccagcgaattaacatcggccagccgttccgcgtccgtaccggcaaaacgctgatagcggcgacgaatcacctcgtcattctccacctgatgacccgcgtcagtcaggcgctgaacgccgcgtaacgcggcctgttggttaatacagtagcccgagggggcgattaaatgaaacagagacatggtaattccttgctgacaatagaatgcaaatgtatatcatgccgcatatattaggcgatgtccctcgttgtgcgacgtttctggatgcgcaccagggaggcaacctaagtacctggccggggcggtataacctcttcggcagataagttacggctataaggatagatgacgtgaaattaagatggtttgcttttttggtagtaatactggctggctgtagctcaaaacaggattacaggaatccaccgtggaatgccgaagtgcctgtaaagcgtgcgatgcagtggatgcccatcagtgaaaaagccggggcggcatggggggttgatccacatttaatcaccgcgattatcgccattgaatccggcggcaaccctaacgcggtcagtaagtccaatgcgattggcctgatgcagttaaaggcgtcgacttccgggcgcgacgtttaccgtcgtatgggctggcgtggcgaaccgaccaccagcgagctgaaaaaccctgagcgtaacatctcaatgggcgcggcgtatctgagcattctggaaaatgggccgctggccggcatcaaagatccgcaggtgatgcaatatgcgctggtcgtctcttatgctaacggcgcaggcgcgttattgcgtactttttcatccgacaggaagaaggcgatagaaaaaattaacgatctggatgctgacgagttttttgaacatgttgttgataatcatcccgcgccgcaggcgccgcgctatatctggaagcttcagcaggcgctggacgccatgtagtttagcgtgaagattattctcgcactttattcgctctttctcgggcgtcgcgctcaagcgaaaaaataatccgctgcaactcccgctccaccgccgggctaacgttaaggaaacgaaagctcaggcggggagtggtgatcgtttcatttttcccatcaatcaccttacgctcgctgatggcgagaagctgggcgtcaacgtgaagaatcccccatggccccatgttcagttcaacctgcgaaaagcgtgcgccttcgattagtccgtcggggatggcggattccagtagcgcgcccatgccgcccagggaaagatcaaacaggcgaaaacgtaacgtacgggtgtccggtagcgtggtgacgccgtaataaggcggatacagcggcgcgccaatgcgaaaatactcccggcgctggacaaaccacagtgatgacggcaggggcgtgataaaggccggcagccgctgatattcacctgtaacgagttgcggcaacgtgaactcgacttttgcgccttgtgtttctgcgataatggctacctgcccggcgcgtaatacggcgctatttttatattcctggctgccgtaatccacgatgagtttttccggggctaccgccaaaattttactaatgaattgaccatgcgcccatgaaatacgcagtggaacctgatttttatttaaatcccgtagcacgcctaatatcgctaatggattttttttcaggaactgctcattgtaaccactcacacgaaataacccctgatacgcagactatcgttgggttatcggcatcagtagaaagaacttaatagcgataaataaatttttatgtccgcgagataaatcagtgttcagaaatgcgacgctcgactttgcctatacttaaaacgtttttactggaaagagggttcgcaaatgggaattatcgcctggattgtttttggtttgattgccggcgttatcgccaaattgcttatgccggggcgcgatggcgggggatttatcctgacctgtattctcggtatcgtcggggcggtcgttggcggatggctggcgacgatgtttggtattggcggcagtatcagcggctttaatctgcacagtttcctggtcgccgtggtgggcgcgattgtggtgctggtgattttccgccttctgcgacgcggctaaccgctgcagaacgtgtaagcgttgacccggtcagcgccgggtcaacctactataaacacgcgttactgcgtcgctgcagacggcgtttttgtcggcgttgcgcttaacgatgccggacgagtagacggtacgctatcgcacggtttttcctgcggacaaatcagatcgagcattttcagcgtcacgccgttgctccagccaaagccgtcctgaaggggatattcgccgccgccaccgccggttccggtactgctgacgtcatatttttcgaccagttttttctcgcgatcgtaggtgtgctgcacattggttaaaaagcgccaggtgacttccattgccacgtcatcctgcccataattttgcaatccttcggcagcgacccattgtaacggcgcccagccatttggcgcatcccactgctgtccgcttttaaccgaggtggtagccagcccgccaggctgtagcagatgcgcctgggccgccgctgccactttcgcggcgcgatctttcgcggcggcgtttacatagagcgggaacagcgcggcagcggtgagttggtcacggattttattgttctgcagatcgtagtcggcataccaaccctctttgttattccacagatgcatttcaatggctttttgccgcgcgttggccagcgcgtcatattgcgaggctttggcccgatcgcccgccgcagcgctggcgcgggcgagggttttctccagctgatacagcagagcgttaagatcgacagggacaatcgtggtggtacgaatggtactgagctgctgcggattatccatccagcgggagctgaaatcccagccggaggcggcagcagatcggaggtctcgatagatctccgttgccgggcggctggggttgcttttggcggtagcgatatcttcaacccaggattcagggcggggcgtatcccgatcgtcccagtagcggttgagaacgctgccgtcctccagtttgacgacgcgttggttttgttgccctggctgcaatgtctcaacgccctccatccagtaggcgtactctttttgcagttgcggcaggtattctttcagcgcatcgtcaccttcatgttgcaccagtaattcaaccataaacgcaaagaaaggcggctgtgaacgactcaggtagtaggtacggttgccgttaggaatatacccccaggcgtcaatttcgtaaccaaagttcgctaccatatccgccaccttatcccagtgcccgctttccgccagccccagcatcgtaaagtagctgtcccagtagtaaatctccctgaatcgcccacccggtacgacataggattcaggcaacggcaagagcgagtcccacttttcgacgtttttagttgaacgggtcagcaccggccacaggccatcaatatgttcacgcaatgattgcccggcaggcgggacatatttttcacccgctttcggcagggtgaagttaacatcaacaaaatgacgcaaatcgaagccggactagttccgctgcatacgataatccgcaagaatcatgagcggatcgctattaggtatggcgtcagcaaaggttttctgatcggggaagagttttgcattctggacatcattaaagagcgggccaagcaaaatatccggcggctgcggagtttcagtgtcggaagacgggtctgcggcagtcgccgaaaacgatgcaaacgtcagcagcgtccctgccagcgccagttttatggctttctgtagtagaacagaacggcgaatctctgggggtatcatcaagttatctccttagcagtgagccaaagccaacggcatttaccatgacaaaaccttagtctacgatgaccagatacgcgtgattgaaccgctattttgcgaacaaacagacattttattgagacagaatttatcggcgcgcgcgtggaaaacggggtatacagacaaaaaatccacgccgggacgtggattttagcgcaatgatttgtcgccttaacctggatagataccgcgatctttacgggccagcagaatgcgctcacaggcgacaatataggctgcggtgcgcagagaacaggatttctcagccgctttctcccagacatggacgatcgcgtcggtcatgattttgtccatgcgcgcgttgatctcttcttcgctccagaagaagctggccatatcttgtacccattcgaagtagctgacggttacgccgcctgcgttacagaccacgtcaggcaccacaaggataccacggctggccagaacatcatcagcatccggataggtcgggccgttagccccttccagcaccagcttacacgtcagggcttccgcgcgctgacgagttatctggccttcaagcgccgccgggatcagaatatccatctccagacgccagaacgcatcgctggcgatagtttccgcgcccgggaaaccggctatctgtttgtgttctgtctgccatgccgtgagcgccttcatgtcaataccggtggcgttaaacagcgtcgcggtatgatcctgaatcgccacgacacgggcgccagcgcctgcaaacagacgcgcggcttcgctgccgacgttaccaaaaccctgaaccgcaacgcgagcgccttcaacggcgatattcgcccgacgcgcggcttccagcccgctgacgaaaacgccgcgccccgtcgccttttcacgacccagcgaaccgccaagatggataggcttaccggtgacgacgccagtgaccgtcgtgccatgattcatggaatacgtatccatcatccaggccatcactttaccgttggtgccgacatccggcgcaggaatatctttctgcggcccgatgataatgccgatctcgctggtatagcggcgggtcaaacgctccagttcaccttccgacagcgagaacggatcgacgcggatgccgcctttggcgccgccgtacggcagattcagcgcggcacatttgatggtcatccatgctgacagggccatcacttcattgagatcaacgtcaggatggtagcgaacaccgcctttacccggacctcgggagaggttgtgctgcacgcgatatccttcgaaatgacgaatagtgccatcatccatttgtaccggaatatcgacgatcagagcgcgttttgggtggcgcagagtatccacctagggggataactcgcccagataaggggccacacgctcgatttgttgcaggtaggtattccaggcagatgtgctgctatctgaagcgtaagataacttatccatgataaaccttagtgataaaagtaatatgttctttaattgaccgtggtacatagtagatcacaccatgtagcgataaatttaacactttttttaaacaattaactcagatcaaaaatggcaggcagttggattttcgttatgattttggatgagaagtggttaactatccgctataagaggtgatatatcgctaattatgcaattaattgcttaaatatgcgtgatatgtgcaaggcggctatttgtcataattatgacgcacctctaaaagtaaagattatgataacgacatgtatcaatgttatgtcgtcctgtcggcggggaaacgtcttcgccaggcgcgtaaaaagataaaaataaccggagtcagacggctctgaccccggtttacctctttattgttgacgcgactcaagccacaccagcaccagcgtcgacagtgagcacatcagcagaatgccgacaaaccacagtaaataccacatcgctctcgctccctaataaagttcatgatcgttgcggcggagggtctccaggttgatacgccccaacattttgtaatagctccacagcgtatagagcagtacgattggcagaaaaatcagcacaatcaccagcatgatttcgagcgtcatctggctggaggtgctgtcccacaccgtcaggctggagagaggactaacactcgacggcatcacaaaaggaaatagcgttatgccggcggtaaagatgacgcaggcctgggtcagggaagcgaacagaaatccacgaatagtctgaccgcgaaggcaggcatagaaagccagaatcggcaggatcataccgagcaacgggatgatgagcagtagcggcgagcgtataaagtggttcatccatgcgccagggagtatcgccacgccttttaagagcggattggaagggccgttggcatcctgcgtgagtaagacaaagccatcaacgccggcccacagccagtaaccggccagcaggaagcagatcacgatcagcagcgcgctgtggcgggtggccgacagagcccgttgacgaataacgccctccgttttcaactgtaaccagacgcctccttgcataatcaccaacgacagactcaataatccacacagtagggcaaagggcgagagtaactgtcagaaggtgccaaaatagtcaacatgaagctgcggcgtgaaggcaaacggcacgcctaaaaacaggttgccgaacgcgatgccgaatacaacggggggcaccaggctgccgataaccagaccggtatcccacagcgcgcgccagcgggcattggcgattttaccccgataatcaaaggccagcgggcgaaggaagagggcacacagcaccaggatcatcgccacataaaaaccggaaaacgcggcggcatagacccgtggccaggcggcgaataatgccccgcccgcgagaatcaaccatacctggtttccttcccagtgggcgccgacgctattgatcaatacccggcgttcgtcatcgttgcgcgctatcagcgggagcaggcaaccgacacccatatcaaacccgtcagttaccataaatgccactaggatgacgccgatcagcagccaccaaatgaaccgcaacgtttcataatccaacatgattgtctcctttatccctgttgttgcgcttgttgttgatgttgcatggcgctcggcccaagacgcgcgtacttctgcatcagatagacttccgcgattaaaaacagggtgtaaagtccgaggataagccccattgagaaggccaactggcccggcgtcagcgcggagtgagcgtaccaggtcggcagaatgtcctgaatcgcccagggctgacggccaaactccgtcataaaccaaccggcttcaatggcaatccacggtaacggcaggctccacagcgtcatacgcaatacccagcgatgctggtcgatacgcattcgcagcgtctgtatcaacgcaatcaacatcaccactaacagcagcgaaccgcagccgaccataatacggaaactccagaacaccggcgccacctgaggaatagcgccacgctgggccgcacgatactgctccggcgtcacatggttcatatccggggcatatttcgccagcagaatgccgtaccccagatcgccctcaacggcgtgaaacgcattcagtacctgcggcgagcgattgccttgcgctatctcctgcatgagtagccaggcctcccggccacgcttcaggcgcggcagagcgtcgtccatcaggttttttaaccccggaaccggcgtatccagcgaatgggtggccagaatacccagcagagcagggatcttcacggcaaatgcattacgctcctgttcctgctgcggccaggcaatcagatgaaacggcgcgggcgcgggttcggtttgccattcgccttccatcgccgccagtttcaccggctgaatttgggcgacctcgtaggccgaactgtcgcccagttgcagggttcccagaatggccagggtgccgaatactgagccgatagcaaacgagcgcaaggccacctcacgctcgcggccacgtagcagatacaaggcgctgatagacataataaacatggcgccggtgacataaccggacatgacggtatggacgaatttcacctggctcaccgggttaaagaccagatcgctgaagctgctcatttccatccgtaacgtatcgatgttgaaatgagcgccggtaggatactgcatccagccattggcattcagaatccataatgctgaaatattggagccgaaggccaccagccaggtgaccagcaggtgttggtatttattcagccgctgccagccgaaaaagaacaggccgacaaaagtggattcgagaaagaaggccagtaacgcttccatcgccagcggcgcgccgaagatatcgcccacatagttggaatagagcgaccagttagtcccgaactgaaactccatggtcaggccgatagccacaccgagagcaaaattgatcccgaagagcttgccccagaaacgcgtcatatcgcggtagacggttttccccgtcaccacatagatcgtctccatgacggccagcaaaaaaatcagcccaagcgtaagaggaacaaataaaaagtgatacagcgcggtcagcgcaaactgccagcgcgataagtcaatgacatcccacatgctaactcctgtaggcagaaagagagtaaaaagctaatcaataccggacaccggtgacgttcctgttgagagcgctagcgcgtctccagccatcggcagacttcatccaggcgctggcgcgaatcggccagatcttccggggccgccagtaccagctccggcaaaggacaaatctcatagctatcgagcaacggccctttaagggcgtccagacagcgcacatgccagagatggcgcaatgctgtggcgttgatttggctttcgccatacccggagatgcgaatctggatgttcccgtgtccgcataaacgcgccagaaaaagacgatcggcctcgctgagcggcagttgggtcaaattgatgctgtgaggttgcaacgccggatcgcgtacgtgcgccaataactcatgggccagcggcagtccattcatcaggccagcgacaggcggaggcagcagagagtcgtcaggcagcgtatcggcagtcgccgcttgccacaatgtcaggggcgcgctacccgcttccagacgatccgtcagcagacgtcggttatgcagatggcgtacccgccacaggccgcagaagatggtctcctggatctcgctttcactcccgtccggatgctgaatgcgtaccgagacttcgccttcgcccaatagcgtattgaggaatgagagatcatcggcattcaggggagataactcccatcccagcacgtcgccgacttccgggatgcgccgggcaagctgacctcgcagatcggtcaacaatgccatcaccgccgggctgtgagcgcagcgttccagcgccgccatacttgggtcgccattgacctgacaggtgagcggtaggggattcatcgagaaactggcgtcatcaggctgcgtgcctggccccagcagatgaaaaaaggcgttgctcattgtgctgtctcctgcgctgcgggagtgtcaaccatcgaacgcatcagcgtgagcagttcagcccagggatgaatgccgctgagcgcgccgcgtagctcgccgtctgtaaaaaccaacgtcgccggaaaccgacgtacattaaagcgatcgccgatagcttcgctttgttcaaggtcggccaccgccacctgccagtcaaactgcgggaactcacgcaggagttcggcaatcatcaccgggttatcgctgacttccggcgtacgccgcggatcgctacttaacaggatgacgccatctccaatccgtttgatccagtcgtctaccgtggaagcctctaccggttgccatccacgggttaacaggcgttgccatagcgcagagaacggggtgtcattcgccacttcttttgccctccagacgtgtctgatactgacgtatgcgcactccctcataattttccatcgacaggcatttatagttcaggcagcgtgcgacctcatttgcctgcggtacgatcccccaggcggccagttgcgccagggcggcctgttctgccgccggtagctggctgcgagctatttcgctcaggctaccgccgtagtcgtccagtagcgccggttgcaggccgaccagcgcaatgtgacagggcagatgtccgcggatgtcggccagcgccagaacttcggaaaaactgttttgatgcaggctcatttttttggcgctgagatacgcggggattttctcgccggcataggttcgcaggctgcccggcgccaggccgtaatcgatcgcgtcaaggagcaggagatggctggcttgctcaacataacctaacaggtttagcccttgcgtaccgccgtccacaatttctacctcttcaggccagtgatatcgggcatacaaacgctccgcgacccggataccgaatccttcatcggcccacagcaggtttcctaatcccatcaccactacacgttgcgcattcatgagggctccttgtcgtgcggtttggggaatttgtggctgcgatagccattgatcatggtggagatcaccgtatcgtcggacataatgtcttcccggatagcgaggtaaacgtgcccgacgatgaaggcggcgatcagccacatgcccagtcggtgccagctgtgaatatcgatggagttgccgccggtccagtagaaaaattcaaccacatagcggaacggcgcaaagatggcatactggctatgctcgccaaacagagcgaaaccggtgaggatcataaataccgataacaggaaatagccgaacatcgcggcctgcgcgataggattatgtccgatgtcgctccccggttttttctccagaaacagataccagcggaccacggagaaagcgccttgccaccaactgcgacgccagaccgggacgataaacagctctcgcgaatagcggttgccgacacaggcccaataaattcgccccagcagtaacacgataaagatcatcgcggcggcaaagtggatcagccggatatagcccatgtaaaacagataggtcgcctcgccactcaccgacggcagcggtcggccaatgaagtagcctgttaccatcagtaccaacatgcaggccaccgttagccagtgccacaggcgtaccggcgcttcaaacacatagtggctgacggcagtatcacgcgcctccccgacgcgtggagatagctttccagtcatcgttcttttccttaacgcttagcgtacctggacggcaatcagttcgctgccgtcgtcgccgagcacgtgggttgaacaggcgaggcaggggtcgaagctgtgcagcgtcctcaggatttctaacggttggtcgggaatcgccatttgcgttcccatcaatgccgcttcataggcgccgatctgttttttaggatcgcgtgggctggcgttccaggtggtggggactacgcactgatagagttcaatcttctgatcgcggattgacgcccagtgtcccaacgctccacgaggcgcttcggtaaaaccgatgccgcggcagtgctgcggccaactggccggttcccatttctcggtattggcggtggccaggtcgccgtttttcaggttggtcataagcctgtcgaaaaaatactgcagcttaccgacggcccattgcgcttcgtgcgcgcggcataaaatacggccaagcgtagactggataccggagagcggcagtttaagggcagacatcatgcgatctaccgactctatggtggcggcatcccctttgtgatacgcgataagcgttcgggcaagcgggccgacttccatggcatgaccccgccagcgcggcgctttaatccaggagtagcgttcctgctcgttgagctgctggatatgcgtatcgctgcctttgacatcacccgggttgtaccagggatcggtaatgccgtcaaaaggatgacggcccagccgatcgtccggatagcggtaccaggcatgatccacaaactcctgtatctgctgcggatcggccaaatctaccggcatgacatttttaaaatcgccattgaccaccgcgccgcccggcattaacaggctttgctggctgaagtcgttggcaatgtccggaaatgcgccgtagctcagcacgcatttatccgacagaccggtgccaatttgactccatgctttattgaactggccgatagccagcgcgtccggaaccatcacgttgttaatgaagtcggcggtgcgggtgatgatcgactgcaccaggttgaggcgctccatattgatagccccgaccgcgccgctttgatcgagattgatcgcgcacggcatcccgccgacgatccagttaggatgggggttcttaccgccaaatatggtatggattttgacgatctcgcgctggaagtcgagggcttcaagatagtgggcaaaacccatcagattagcctctggcgacagtttgtactgtggatgtccccaatagccgttacggaatatcccaagctggccgccatcgacaaatttcttcaatcgattttgtacgtcaaagaagtagcccggcgatgacatcggccaggcggaaaggctttgcgccagctgcgaggtggcgcgtggatcggctttcagcgcattcagaacatcaatccagtccatgccggctaactgataaaaatggaccaaatgatcgtggcaccacaacgtagccagcatgatgttacgtataatattggcgttatccggtacctggataccaatcgcatcttcgatagcgtacaccgacgccagagcatgtaccccggtacagacaccacaaatacgttcaacaaacgcccaggcgtcacgtgggtcacggccttgcagaatgatctccagcccgcggaacatcgtgccgcaggaaacggcattggtaatgacgttttgctcatcaatgttcacttcgcagcgcatatgcccttcgatgcgggtaatcgggtccacgatcagacgacggccggcgtcgttaacggtataaccctgggtttgatactggttactcatgcctgtttatcctcattgtccggctgttgttcggcttgcgctaactgttgtttgtggcgtttacgttggttgagcgcgctggcgacagcgtgaccgccaacgcccgcagcgaccacgcccagcgcggtcagccccaccgtatcggcggttgaatgggtacccatctggggaatatccaccacgcggctataaaacgagccgcgatcccagaaaccattttctgaacatcccagacatccgtgaccggactggataggaaaggagacgccgtcattccagcgtgtggaggagcaggcgttataggtggttggccctttacagcccatcttgtacaggcagtatcccttgcgggcggcgtcatcatcccagctctcgacaaattcaccggcatcaaaatgggcgcgacggtagcatttatcgtggatacgctgaccatagaacatcagtggacggcccatgcgatcgagttccggcagacgatcaaacgtcaccatataggtgataatggcgctcatgacatccgggattggtggacatccagggactttcacgatcggcttgtcggtgatcactttatcgataggcgttgcctgggtcggattggggcgggcggcctagacgcaaccccaggaggcgcagtttccccaggcgataatagcgctggcgcccgcggcggctttcttcagtttttcaataaacgggcggccgccgctgatacagaacattccttgctctcctaacggcggattgccttccaccgccagaatgtatttcccggcgtagcgagtggtaatatcgtcaaagacttcttcggcctgtgcgccggcggcggccatcagggtgtcgtcataatcgagggaaatcagcgagaggatcacatctttggctagcgggtgcgaggaacggataaaggattcggtacagcaggtgcattccagtccatgaatccagaccaccggaatccgcggtttattctccagcgcccaggcgatctttggcgtcattccggcgcccagtcccagcgatgtggcggcaaggctacagaatttgagaaagctgcgtcgggtcactcccttacgacgcatggcttgataaaaggtctcctcgttattcataacgcgtattttttctcctttttgcaccacgctccgccaggggcataaggcgcttttgcgggtccgttgacgttccgccagcaaggtaaatcattgtgttacgcgcgagcgcggaaacgagcccgattcactttgcaccgacgtataccgccagaaataatgtgaaaaaagcgtatcggattaacgataagaaacaatgtgaagtgtgtgggtatagcttatagcggtatatttatacccattatcggtttttcggcgaaagggccgtggcggggaagcgcggttgagtttgttccgggatgaggttttcagtgagcaacctcaagtggatttagcctggtctcgccatttcagggatacgtaagttgatgcaaaaggagggaggatttgatgtcatcgttaaaagaagcatacttcgtgatgatttttatataaaatgatggtgctggttttaaaggaatgcaaaaaagagactgtttgaaagagggcgtcccatgaaaaataacatcagatttgacttatccgattatttgattcatttttttcgggacgttgatttagagaccggtagccatatttatttacctgaacactgtggttttaataatcagcaccatgcatgttccattgatgctaaatatttacttagattatctttacgcagtcataaaattttctcgtcctggtcataccgaaatggacaacgaaccgtatatggtgactccccggtggtatgctttacagatatgccgattgcagcttatttagaaactggtgttcgccgattagaacgaaatgaaaatattggtttatatgcaatcgttttacctaaagagcaaatgtttaattatggggcaaggccagtcatatatgggttggatcagcataacaatgctcgatgctcgcaaggcagatatggggaacgtattcttgatgaaacggctcttcctctgattgaacaatatagatatgttacttatgttccaggtaagattgactggacacatgaacgcgaatggcgatggccatatcgtggcgatattaaaaaattccttaatcatattaaagagtatggtattccggaaaacattgaaagtaccccagggtttgattttagatcaagcgaaataagtggtgcgggaataatcgtcccgtttgcagaagatatccctaccgtagctcacgatattttaactttaattgaccggggtgtcattggaagaaatactttcaaattcattatagctgtagagagtttacaatcatggacccagctctcggaaccgggtgcgttactatcctatattaatgacaatactttcgaatttgaatctttttttgatttatctgcatctaaagtaaaaaattatgctgactctatcaatgattatgtaagtgaattatattcaaaaaaagattttttaaatgataattatgcaatggaatttggaaatgcctgggtctggattcatgataaccaatcccaggtggtacgggcgttactgcaggctggaatgatcaaggttaataaagaagggcggtacttattagatgttaatttggcttctgttgattggccattaagaagaaaagaggctttcgcaagtcatgttgcgggatggctcaaacatcgttttgatatcgaagcgggaaggtattccgttcggggaaaagatgattatgatgcgatcccaagttatgagacgccgctaaaggatcagcatcctttttataatcatacagtgaatgtcgactggtaattaagaaaaaaacttaccctgttagctctgcgttaattgagcctgtcagtatgagttgagatattatgaaataaaaaatccacgcggctgcgtggattttatgagtttctttgcctcttatgagattcagcaaaacctcataagacaacaatttttacttagacgttgaacaggaagttcattatatcgccatctttaacgatataatctttgccttccgctcgcatcttaccggcttctttcgcgccttgttcacctttataggtaataaagtcgtcaaaggcgatagtttgagcgcggataaagcctttttcgaagtcggtatggattttacctgctgcttgcggcgcggttgcgccaaccggaatggtccatgcgcgaacttctttcaccccggcggtgaagtaggtctggaggttcagcaggcgataaccagcgcgaataacgcggttcagccccggttcttccagacccagttcagccataaattcgtcacgctcgtcatcatccagctcagcaatatcagcttcgacggcggcacacaccggaaccacgaccgaaccttctttcgcggcgatttcgcgaacctggtccagatacgggttattttcaaaaccgtcttcattgacgttagcgatatacattgtcggcttcagcgtcaggaagcttaaataacggatagccgctttatcttcgtccgtcaggtccagcgaacgcagcatccccgcttcggccaggtgcggcaggcatttttccagcgcggccagttccgctttggcgtctttatcgccgcctttggctttcttctgtacgcgatggatcgcgcgctcgcaggtatcgaggtcagccagcgccagctcggtattgataacatcaatatcttctgccggatttactttacccgccacgtggatgatattgtcgttctcaaagcagcgaaccacgtgaccgatagcttcggtttcacggatattggtcaggaactggttacccaacccttcgcctttggatgcgccttttaccagaccggcgatatccacgaactccatcgtggttggtagaatgcgttgcggtttaacaatctcagccaactggtccagacgcggatcgggcatcggcacgacaccggtattcggttcgatagtgcagaacggaaagtttgccgcttcaataccggcttttgtcagcgcgttgaacagggtggatttcccgacgttgggcagaccgacgataccgcatttgaatcccatgatttaactcaccttaatatcttaataatcaacctgttatagaaaacagattgcagaaatggaaataacttcgcctattatacacggcgtgcggcaaaaatgccgcacatcactggttattgcgccttaaaggtatgcaaacggcttgttgctttggccagaccctctttgaaccacaattccgtacagcgcgccgcttcgtcaatggcctcatcaattaatttttgttcagaaacagggggtttacccagcacgaaaccaacaactttatttttatcgcctggatgaccaattccaacgcgtaagcggtgaaagttgggattattgcccagcttgctgatgatgtctttcagaccattgtggccgccgtggccgccgccaagtttaaatttcgcgacgcccggcgggagatccagctcgtcgtgagcgaccagaatttcgtccggctgaatacggtaaaaactggccattgcgccaactgctttaccactgaggttcatgaacgtggtgggtaccagcaggcgaacatcttccccttccagcgtgatgcgtgaggtatagccaaagaatttaggctcttcacgcaacggcgcgcgcaggcgctccgccagtaaatcgacgtaccatgcgcctgcattgtgtcgcgtcgcggcatattccgcgccgggattcgccagaccaacaatcaatttaattgccacgttttttgtcctgagtagatccatgactggcgcgtagtttactgtctgtctgcccgcttgacaaaacacagcgacactctgaagtaaattaaataattgccagcattgattattaaaaatgtaaactgttcagagtgttatttgtaaagttttgttaaatgaaactttacatttgtgatcgcacccgcacttacaaatggaagtgttgtctatactttacacataaagtttagggggatttcctaaaaacaacccaaaagttccggaggtgacatatgaaacgcaaaaacgcttcgttattcggtaacgtgctgatggggttggggctggtcgtgatggttgtcggcgtgggttactctattttaaaccaactgccgcagtttaatttgccgcaattttttgcgcatggcgcaatactgagcatttttgtcggtgcagttctttggctggcgggggctcgtgtaggggggcatgagcaggtgagcgacaaatattagtgggtacgtcactatgacaaacgttgccgccgtagcgacaatcgtcgtcatagctaaccggttcaggcccggtaagcgttatcgccaccgggcattgtccattaactgagtaaatccgctaacgcctccgtcctgttcgggaagaaggtcagacgtccaggaatgggtttgataccggcacgcgccattgtgcgcagcggttggaactccaggttactgatacgcaattcgcaaccctccggcagacgcttcacaaaacgctgaaaagcatcaagcccgcctgcatccagcactggtactgcgtcccatttcagaacgacgatacgtttgcccttaatacgtgactcaaggtcggtaaacagcccttccgccgcggcgaaaaagagcggaccgataacacgcagcaccagcacatcttcaggcacatcgacattgaccggcgcaagtcgagtcattcgcgcaatacggcgcataaacagcagggaagcaaggacaatccccacgctgatggcgatgaccatatcaaacagaaccgttaatgacatgcacagcagcataacgataatgtcatctttcggcgcatggcgtaacagatccaccactttatgggcttcactcatattccatgccaccatcagcagtagcgccgccatcgcggaaagcggcagccaggagagtagcggggctaagaccagtagcgccagaatgaccagaatagcgtgaattaccgccgagacgggagaggtcgcgccagcgcggacgttggcggcagagcgggcaatcgcggcggtggcggtgatgccgccaaagaacggcgcgaccatattccccagcccctggccgataagttcgctgttagctttatgtttggtgccggtcatgccgtccagcacgacggcgcagagcaatgattcgattgcccccagcattgccatcgagaaagccgctggcagcagcgcgcgcagtgaatcccagcttagcgtaaaatcggagccaggaaggctccacggcagcatcagttgcggcaggagctgcgggatgccgttgccctgagtgccgtcagccagaacgtaatggaactgtgagccgatagtcgccacattgccgcccagcagattaacaatccccattacggcgcaaccggccagcagcgcgggaaggtgtcccggcagacgaataccgagacgcggccagaaaatcagcgttcccagcgttaccacgccaatggcggcatcgccaatattgacggtgggcaacgccataaacagcgcgccgactttctgcaaatagtgctctggcacatgggccatctgcagaccaagaaaatctttaatctgcatggtaccgatggtaataccaatccctgaggtaaaacccaacgtgaccgacaccgggatatattcaatcaatcgccccagtctcgccaggccgaaaaggatcaggaagaagcccgacatcagcgtggcgaccagtaggcccgccagaccaaactgttgcgacaccggatacaaaatcaccacaaacgcggcggtagggccggaaacgctaaagcgcgagccgccggttagcgcgatcacgatcccggcgacagcggaggtatagaggccatactgcggcgcaacgccactgccaattgccagcgccatcgccagcgggatagcaataatcccgacggtgatcccggctatcacatcacgggtgaaccgggaggcggtatatttttctttccagcaagcatcgatgagagcgcggaaaggcatcacatgtgaggaaaataatttgttcacaataatgtttcatccatgagcgcatcatctgtcaactaaatggcaggtgaaggaggcataagtcatataaaagggtgttacagacaaaaaaacccgccgcagcgggtttcagatccgggttcgatcaatgctcgaacatggcggaaatcgattcttcgttgctgatacggcgaatcgcttcggccagcatacctgacagggtcaaagtacgcacgttcggcagcgctttgatttcgtcggtcagcggaatggtgtcacagacaacgacttcgtcaataacggagttgcgcaggttgtttgccgcattgcctgagaagatcgggtgcgtcgcgtaggcaaacacgcgtttagcgccacgttctttcaatgcttctgctgctttgcacagagtaccgccggtatcgatcatatcatcaaccagcacgcagtcacggccagcgacgtcgccgatgatgtgcatcacctgagaaacgttcgcgcgcggacgacgtttatcaatgatagccatatcggtatcgttcagcagcttagcgatagcgcgggcacgaaccacgccgccaatatccggggaaaccacgattgggttatccagattcagttgcagcatatcttcgagcaggattgggctaccgaacacgttatcaaccggaacgtcaaagaagccctggatctgttcagcatgcagatctacggtgagaacgcggtcaacgccgacgctggacaggaagtcagcgacaacttttgcggtaatcggcacacgggcggaacgtacgcgacggtcctgacgtgcatagccaaagtaggggataacggcggtgatacgacctgcggaagcacgacgcagggcatcaaccataacgaccaattccatcaggttgtcgttggttggggcacaagtggactggatgatgaaaatatcaccaccgcgtacattttcgttgatttgtacgctgacttcgccgtcgctaaagcgacctacggcggcgtcgccgagagaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcaaaatcctatccaggcggtgtattaaagagcgcgatgcaacgtctggaacaaggtgacgttgtcaccgaagctcagcttgcccggcttactcgtcttcattcacgtttcatgtgcgctggtatcaatgcctcacaccggtcaaatacggcatatatgaccggcgactcgtcatttcgccatcttcctgaaacccgaatgcgttagagtaactctcgatgcaatggggaaaggttaacacccttcgccacaaaagcattgagccattccggggcttgctcaagcacctggcgagcacaagactctgtatcgaattcagcaaagacacaggcccctgtcccagtcaggcgcgacggcgcgtattctaacagccaggaaagcgccgcatcaacctcgcgaaaacgttttcttgcgataacctcgcaatcattgctgaattcacattttagtaacgtatctattgacctttttggcgtattacgcggcaattgaggatctttaaagataactggcgtcggaatgcttacgccagggtgcgcgaccagataccatttttccggcggattcaccggcgttaatatttcgcctacgccttcggcaaacgcggcgtggccacgaacaaagaccgggacgtcggcgccgagcgtcaggccgagcgtcgccagttcatcaatggaaagcccgcattgccaaagatgattgagcgccaccagaacggtcgcggcgttagacgagccgccacccagaccgccgcccatgggaaggcgcttctcaatgctgatatccgcgccgcttccggcgggcaggcgtccactctccgaggcgactttcatcaacagccgcgcggcgcggacgatcagattgtcttcattttcaacgccggttaccggcgttaataaatggatttcgccatcgtgacgcggttcgatgtggagtgtgtcgccataatccagaaactgaaacagcgtctgcagcgtgtggtagccgtctgcacgctgtccggtgatatataaaaacagatttaattttgccggagaaggccaatgggtcatcatttcacaatccagttatccattttcagcttaatgcgctgactgccatctgaaagctccatattggctggcatggcaggctgcgttttgctgtcatagccaccgtaaaccactttccagtttttaccatcctggtggtagttcacttcgctcaggcggtactggtcgtccagtttgtagtcggtggcatcgccaggcagaccgaggatccactgccgcaggctgtttaacggaatcggcatcccggtgagtttgccgatcatctcttcggcgtcatcggcggtataacgctggcctttgttatccaccaactggacgttgcccggctgggcgttaagctccagctcggtgctgcccagcgggttggtaagcagcaggcggtagcgatcctgtccggtctgttgccagaagaagcgcgcatagactttctgatcatctgagatgtaagcaaaggcgccgcgcgtctggtattgattcagatgacgcacctcttgctgatgctggcgccactgaggggaatccgggctcttgcccgggcctttatgcccaggaagcgtacaggcggtgagaaccaggcttgctaacggcagtagacgaatcaggcgaaaatcgggcagggtcatagtgatgacgaatccttgtgatacggtgcaataattgcctgaaggcgttacgcttatcaggcctgaaaactgaaccggcaagctgtaaaaacgttcgcgccgcgattcggcaaatttttgctatcggttacagttatagcctttaatgctagcgccgcctggtgacatcgtctactttcaagttgtcttaaatcatcaaattagcgagcgctgccaattactccaaaagggggctctctcttttattgaccacgcgcatcctgtatgatgcaagcagactaaccatatcaacgctggtactactcccgcagacatgacccttttagcactcggtattaaccataaaacggcacctgtatcgctgcgagaacgcgtaacgttttcgccggacacgcttgatcaggcgctggacagcctgcttgcgcagccaatggtgcagggcggggtcgtgctgtcaacctgtaaccgtacagagctgtatttgagcgtggaagagcaggataacctgcaagaagcgctgatccgctggttatgcgattaccataacctgaacgaggacgatctgcgcaacagtctgtactggcatcaggacaatgacgccgtcagccacctgatgcgcgtcgccagcggtctggattcactggtgctgggcgaaccgcaaatcctcggtcaggtgaaaaaagcgtttgcggattcgcaaaaaggccaccttaacgccagcgcgctggagcgaatgtttcagaagtctttttccgtcgccaagcgagtgcggactgaaaccgatatcggcgccagcgccgtctccgtcgcgtttgccgcctgtacgctcgcccgccaaatctttgaatcgctctcgacggtcactgtactgttagttggcgcgggcgaaactattgaactggtggcgcgtcacctgcgcgagcataaagtacaaaagatgattatcgccaaccgaacccgcgagcgcgcgcaagccctggcggatgaggttggcgctgaggttatctcgctcagcgatatcgacgcccgcttgcaggatgccgatattatcatcagttcgaccgccagcccgctgccgattatcggtaaaggcatggtggagcgcgcattaaaaagccgtcgcaaccagccgatgctgctggtggatatcgccgtaccgcgcgacgttgagccggaagtcggcaaactggcgaacgcttatctttatagcgtcgatgatttacagagcatcatttcgcataatctggcgcagcgtcaggctgcggcggtggaagcggaaacgattgttgagcaggaagccagcgagtttatggcctggctacgcgcccagggggccagcgagaccattcgggaataccgtagtcagtcggagcagattcgtgacgaactgactaccaaagcgctgtcggcccttcaacagggcggtgatgcgcaagccatcttgcaggatctggcatggaaactgaccaaccgcctgattcatgcgccaacgaaatcacttcaacaggctgcccgtgacggggatgacgaacgcctgaatattctgcgcgacagcctcgggctggagtagcagcacacaccacacttttttacagggtgaatttacgcctatgaagccttctatcgttgccaaactggaagccctgcacgaacgccatgaggaagttcaggcgttgctgggcgatgcgggaattatcgccgaccaggaccgctttcgcgcattgtcgcgcgaatatgcgcaattaagcgacgtttctcgctgttttacggactggcaacaggttcaggacgatatcgagacggctcagatgatgctcgacgatcctgaaatgcgggaaatggcgcaggaagaactgcgcgaagcgaaagaaaaaagcgaacaactggagcaacagttacaggtactgctgctgccgaaagatccggacgatgaacgaaacgcgttccttgaggttcgcgccggcactggcggcgacgaagccgcgctgtttgccggcgatctgttccgcatgtacagccgttatgccgaagcgcgccgctggcgcgtggagatcatgagcatgagcgaaggcgagcatggcggttataaagagatcatcgccaaaatcagcggcgacggcgtgtatggccgactgaaatttgagtccggcggacaccgcgtacagcgtgttccggcgaccgagtcgcaggggcgtatccatacctccgcctgtaccgtcgccgtgatgccggagctgccggaagccgagctgccggatattaacccggcggatctgcgcattgatacgtttcgttcttccggcgcgggcggtcagcacgttaacaccaccgactccgctatccgtattacccacttgccgaccggcatcgtggtggaatgccaggacgagcgttcgcagcataaaaacaaagcgaaagcgctctcggtgctcggggcgcgcattcacgccgccgaaacggcaaaacgccagcaggccgaggcgtcaacgcgccgcaacctgcttggcagcggcgatcgcagcgatcgtaaccggacctataatttcccgcaggggcgcgtgaccgatcatcgtattaatctgacgttatatcgccttgatgaaacgatggaaggtaagctggatatgctgattgagccgattgttcaggaacaccaggctgacctgttagccgcgttgtccgagcaggaataatggattttcagcactggctacatgaggcggtaaaccagctccgggacagcgacagcccccggcgcgacgccgagatcctgcttgagtacgttacgggcaagaggcggacgtatatcatggcctttggcgaaacgccgcttaccgatgtccagcaacaacagctcgcggagctgctgcagcggcgtaaacagggcgaacccattgcgtacctgacgggcttacgcgaattttggtcgctgccgctcttcgtttctcccgccacgctaatcccgcgcccggataccgaatgtctggttgaacaggcgttggcgcgattgccggtcaaaacctgtcgtattctggatttaggcaccggaaccggcgcgattgcgctggcgctggcctgcgagcgaccggattgcgaggtgactgcggtcgatcgtatgcctgatgcggttgcgctggcgatacgcaacgcggaacatttggctatccggaatgtgcgtatactgcaaagttgttggttcagcgcactatcggggcagcagttcgacatgattgtcagcaatccgccctacattgacgcgcaggacccgcaccttagcgaaggcgatgtacgctttgaaccgcgctcagcgttggtggcggacgaaaacggtatggcggatcttacgcatattatcgataatgcccgccagatgttaacgcccggcggcttcctgctgctggaacacggttggcggcagggcgaagcggtaagagcggctttcaggcggtctggttacacggatgtagaaacgtgtcgtgattatggtggcaatgaacgcgtggcctgcgggcgttttacgccatgacaattgcaatgttgctcacgcttcatcttatttgtgttgcgctctccgtcagtttgtttgtcgctcgttactggtggcgctattgcggccatgcgttggccgccgcgcgctggacacgaatcgtgcctcccgtcatagataccctgttactgcttagcggtattgggttaatcgttaaaacgcacatcctgccattcacggagtcgggctcatggctgactgaaaaactgtttggcgttatcatctacatcgttttgggttttattgcgcttgattatcgtcaggcgcgcagccagcaggcgcgttttatcgctttcccgctggcgctggtggtgctgtacatcatcattaaactcgccaccacaaaaataccgttactggggtaagtcatgaggtcgttagctgatttcgaatttaacaatgcgccgctgtgtgatggcatgatcctggcatcagagatgattcgcctggattttcccacgcagtttgtctacgacgaactggaacgtctggtcagtctggcgcaggaagaaattagccagctcctgtctcaggatgagcaactggaaaaattgctggcacttttttacggcgagtgggggttcacggattcccgcggcgtctaccgtctttctgatgctttatggctcgataaagtcctgaaaaaacgccaggggagcgctgtatcgttgggcgctattttattatggatagcaaaccgtcttgatttgccgttggtgcccgttatcttcccaacgcagctgattttgcgtattgaatcgctggaaggagaaatgtggctgattaacccgttcaacggtgaaacgcttgatgaacataccctcgaagtctggttaaaaggcaatattagtccggtcgccgagttgtttaacgaagatttggacgaagcggataacgccgaagtgattcgtaagctactggatacgctgaaatcctcgctgatggaggaacggcaaatggagctggcgctgcgcgttagcgaagcattgttgcaatttaacccggaagatccttacgaaatccgtgaccgcgggttgatctacgcgcagcttgagtgtgaacacgttgcgctgactgatttaagctacttcgttgaacagtgtccggaagacccgatcagcgaaatgattcgtgcgcagatcaacaccattgcgcacaagcaaattgttctacattaattaaccgacattttacctataagtgtaaggcgatcctatgaaacaaaaagtggttaacattggcgacattaaggtggcaaatgacctgccgtttgtgctgtttggcggtatgaacgtgctggagtcacgcgatctggcaatgcgcatttgtgagcactacgtaaccgttacccagaagctgggtattccttacgtgttcaaggcctcttttgataaagccaaccgttcctctattcactcttaccgtgggccgggtctggaagaagggatgaaaatcttccaggaactcaaacagacatttggcgtaaaagtgatcactgacgtccatgaagccagccaggcgcagcctgtggctgatgtggttgacgtgattcagctcccggcgtttttggcgcgccagaccgacctggtggaagcgatggcgaaaaccggcgctgtgattaacgtgaaaaagccgcagtttgtaagcccgggtcagatgggcaatatcgtggataagttccatgagggcggtaacgataaggtgattctgtgcgatcgcggcgcgaacttcggttatgacaacctggtggtggatatgctgggctttagcgtgatgaaaaaggtctccggcaactcgccggtgattttcgacgttacccatgcgctgcaatgccgcgacccatttggcgctgcctcgggcggtcgtcgtggtcaggtgaccgagctggcgcgcgccggtatggctgtcggtctggcgggcctgttcctggagtcgcatccggacccggctaacgcgaagtgcgacggtccttccgcgctgccgctggcgaaactggagcagttcctgacccagataaaagcgattgatgatttggtgaaaagcttcgacgagctggataccgagaactgattgcggtttttagcttgtgtaggccggataagatactatccggcttttttgtctatggaaaacccccagctaggctgggggttccggaaagctttcagctttaagccagttattaaaaccccttttgatttgttaaaacatcttgcggtctggcgactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattattagtattcgaacggttatcaaaataatttatcaaaacgtcctcaattcagaccgcaatagtagtccatcctttaccccgatcgtcatgataacctgagaccccctgaaagctgatagttaccgattttgattgtggtggttttctttatgatgtgtggtttggctattttttgaaagtgccttaccagatttattgttattatcaggggattatttcaataaaaggtgatgatttattgcctgcaatagtgggtagattaagcattttatgaaattattagtgtctttatttgcacttctacaagactgttaagaggtgttgaaatatcagcctggtaaagaatacgtcagcgaaagtgaatgctatattagtcataaaaattcaggagacatatgctcaaacctatcttctacagtggaagtgtgaaggttccggaatgtctggaaacagataaggaaaaaaatgtcggacgtactcctctgtcttcagacattcagcaaattaaaaatgttgttgaagatattccgccatttccagaaagcagagcggtgggaggttctgtaagcgcagcgtacaggctttcttttgacgaagtgttttgcggtctcagcaatgaagagcgtaaaaaggtgtatggtcgcctttttggaaaacaagtacttgcgcatattcattccaggtgtcagcgcgacgctgacataataagagaaaaagcgctcaggcggataagccgtgagtgtggtaccgaaatagattgcgctctcttactaaataagatggtggatattttacaaaatgcccggctgacaataaattttaatgcagcaaaaattgactttgtctctctcttaaaaaataaagaatatctgaactcttatgcattaggttgcagaccaggagatttacctgcttataatgtcgggcgtgattcagttgaaactaaagcatttgaactggagaagcttgcagattcaccttatgccccatatggtcagacaggcggtttttccgtagcatatactcccaacagtaaaacttttagccctacaagcagaccaatttatgctgcactggactttctgaacggtgaaaatggaggtgccagcgcctatgggaaatcattttttgaattaaatgataatgtaaaaacaaattgtacattctcaccttttgatatctacggccacagatttggcctggatactagtaaattatctacattttgccatatggagaacctgattgcatcctgtcaaaatgatttttttggttataattgctttaagagtttggttaaaatggctaagggcgaaaaatttttagctcattctaattatggtacaggctatgaagggaattatatagaggctcatattcatggtgatgtatgtttattcagagatataaagcacgtttatttgtctttgcaagaaaactcttactcggaaagtcaactatatgattatgcaaaacaaataaaccaggcgcttaatagagactgcataatattatattgacaagcttattatcaggctctttaaaagagctttaaatgatcatgagcacatacttcttaaggtaggcagtaactgcttttatatttattatagcaggaccgctctggcagatacctgtgtggcacctcagtatggcctgaaaaatagaggaatatggaccagcagaagcgcctgctggctacttttcacttaaatcgctggaattcaccggcgctacagatgaagcgaccttaacagtcatcaggtgtcctgcattaccacaggagtgatttactggctatcgatattcctgctcatcaggtttttacgccatctacgcacatttattctgctataagttgaaatactgcaaaaaatattaaggcttattattttttctttaagcaaattttcgttcaacaaacttggatgcgggaatgtgtgaaatatcatttctttatactagaactcagcgacctacagctcacaactttattagatcctcttcctgaatatattacttttctggcagttatcaacaataggctgactaaattgccggacactttgcctggagggtacagacagattacgcgggtaggatcactacaccgggaaaagattgccagttaatgggatgtcgtccatgtttcagttggaggataatgatttatttccccctctttgaccctacaatagtgatctgatagttatcctgaacgttcttacagagggcgggcttgttaaataatcatcaagttattaatgagttatgtcctgctttgctgaaaataaaaatcagtagacagacgacggcgaacaatatgagccggaagtgcctgtgttattactgtggcgtgaattctgtaactgataaagtaggtgtgcttattatcagtaatgaaattttttatatatgtattattactattcacaggtaatttgattgtttgttgtgagtaacattgtgttgaagtaaaccatgatagactggactgtgatgtggtgagatataatgaatttgtgttttattaattattttaaacgtacaggagagtagtatgtatatgagtaagtatgtacctgtttatacattattaattctcatttattcttttaatgccagcgctgagtggacaggagataatacgaacgcctactactcagacgaagttatcagtgaattacatgttggtcagatagatactagtccttatttttgcataaaaacggttaaagctaacggtagcggtacaccagttgttgcatgtgcggtatcaaagcagagcatatgggcgccctcctttaaagaacttcttgatcaggcaagatatttttacagtacagggcaatccgtaaggattcatgttcaaaaaaatatctggacctatccgctttttgttaataccttttcagcaaatgctcttgtgggactatcatcgtgcagtgcgacacaatgctttggacccaagtaagaggggagaagaaataatgaaaaagttaatattcttaaccttatctatagttagctttaataactatgctgtagattttgtgtatcgtgtggactcaaccccgccggacgttatttttcgcgatgggttttcactacttgggtataaccgtaactttcagcaatttattagtggaaggtcatgtagtggtggaagtagtgacagtcgctatattgcaacaacctcaagtgttaatcaaacatatgctatagccagagcgtactattctcgctcaacattcaaaggtaatttatacagatatcagattcgtgcagataataatttctacagcttgctcccatccatcacctatctggaaacgcaaggtggtcactttaatgcttatgaaaaaacgatgatgcgattgcaaagagagtatgtttccacattatctattttacccgagaatattcaaaaggccgtggcgctagtttatgatagcgcaaccggtctagtaaaggatggtgtaagcacaatgaatgccagttatttaggtttaagcactacgtctaatcctggtgtgataccttttcttccggaaccgcagacgtatacccaacaacgaattgatgcattcggcccattaataagttcatgcttttcaataggtagcgtatgtcattcacatcgagggcaaagagctgacgtatacaacatgtctttttatgatgcaagacctgtaatagaacttatactttctaaataaatgaaacttacctatgttgcctattaaattaaacagcccgtttattagttgcctggttaatattgtttattaagttggctatccacttaaatataaatgtttatatacttcgataagttttttatcagattcattgcattaccaatcatagcattcaggtacgtattttattaatattagaaggagtcattatgactaaagatgaaatctttgcagctatccttagtagagaaggcggttacgttgatcaccctgacgacaggggggggccaacgcattggggtataaccctgacgacggcccgggctaatggctatatgggggatatgcggaatcttacccgtaatcaagcattaaaaatccttgaggcagattattggtatggtccacgacttgatcaggttgccattatctctcactctattgcagctgagctttgtgatactggtgtgaacatgggaccctcaatcccgattaagtacttccagcgttggcttaatgtttttaatgatcagcaaaaaatttatccggatttgatagcagatggtcagattgggccacggacgctttcggcactaacattttttctctctcaccggagagatgagggcgaaatgatacttatccgggcattgaattgtagtcagggacaacgctatctggagttagctgaaaagcgccaggcgaatgaatcatttgtttatggatggataaaggaacgggtaagattgtaattcccttacttaccactatagcggtttgtgatgatagcatataatgatatattcacacagagaactggtgaaagccactaagtctcattattactatattaaggcgtcaggtttttctatagttctttgtgtgttaaaaacgagaaattaattatgttgtatggtatgagaatgatagtatttccagccaaatattcttacggctaaatacattattatccttttccattttggcacgcccagaactttcatcccatccaggaatatgagatcggactcttttctgttacgtaatggataatgatacaggtagtcatgaatgattgccgctttggcatattcaccatccggtggcaataatgaccagaaaatacgcggaacagtggcaaggtcggtaacgaatcctaccggtacttcaatgacatcatttttatcttcactgagataaaacctgaatggctcataaacacgccatttataatgacctaacatttccataattgctggactggtaaaacaactcataattttaccttataataaatatatattctgcaccttacgctcaaagtacatgtcgtaaactctatttactcattaacagcttcgtgccaaaaaggctacgggataatgatcagaagcgagttgtggattacgtaatgcttcaaccctttgtgaataaggtgctcgatcgacaatgaccccataatctaaaataccaccgccaatttgcgtgggttctgtaggtgcgagtacggctacaactcgttccagatgctcagtcatcaggtcattttcaagtctgtctgggctgcgattaaaatccccggcaagaaaccaggataaatgccgcatctgaggttgtctaaaaaaattaatggtaaccctgacaatagctgcagcatccggacctccactagccagtgcgtgcgctgtcagaaaaacatcattacccagtccgatgccaatgacggggcgagatgcgacagttgtcggacgcaagacataaacattatccgctctttgtctggaaactattgccagattaacacggcgtgctccaacatcaatagccgagtggtagatatatcttatatcctgacggctggtggttccgagattccaggtgtattcatcaatgggaatacccactccaaaaggctgaatatgtcgtccggtaggaaccgctgaggtgggaacagcaccggcctcctgtaccataagaatatccacaccggcagtaccacttaaaagctgtctgacattgacattccatttactttctgtagatgctgaagagccctgaagattccaggtcataactttgtagtcactgatattagcgcaggcaaaagaaatatagctgcagatgatcatggtcagaaggaaaaaaacaggttttttcataatatctactctcccgagcattacttctttatctgaatgatatatgtgttaataacccattgtttcatgacgttgattttattctggcaatgcctgacttgtttctggttctatgtcttgtgtaggtagtaagatacatagtctaacgtcaataaaactaaaatggatgtctattacagaggtaaaatgaagtttattcagtacaatcaattaattattgttaataccaaagagacaactatgaataaacaactaactgaatttaaaactccattcgcttaactcattgtaactgtattgggttgatttatttgcggaaagagagattcgatatcattggtactttataagtaaacataaatttttcattaccaggattattatatccctgtgagggaggtgacatttcatctattctcactcttgtagtgacatagtaaatttggccacctgattaaaggcgatgttctcacctcaacacaaaacaggtaacttagtgaacaagaaaaccaaacaaatcaatggttacatcttgaacggctacaatagcgtcagacctcatcattataacggtgcactgacgccggaagagtctgagaacaggtaccgtttttactgtaaaaccgtgaccaatagcgtcgatgcgcaacaaaacgtataatccgttgatagggcgtacaggtgtggcactgggcaaaacgttcagtgacaatgactggagctggcggcatttggcaaatagcatgttgaccacgctataaacgccaacttccgctacatgttctgagtggtggcgtttgcgttatatcgtcacagacagcgcctcagggcgctgttttcgatcggacatgtcgctttcgcaggaggggacgttattcggcgaccagccacatatcagcctcttcaaacatctcttccagcatacggtgcagccgttctttctcggtttttgtacagtcactgtttaatgcgttcgcctgcattggcttaactttcacttgcgcatcgggaaaaagttgatgtacgcgttttgtgagttcattgaggatgatttcgcgtgcgcttggcaaaccttcaacatttcgcttgtcataaacgagttcgacgaacatcgctatttcctttttactggttggatgaccagtatttaagctgggtatataaccggtgtcaaggtttagccgccgttttgtcatcctaacgttgcggatgtaaagtaaattgatcgcacatggaagtaaaggtcgctaacctgttgtcatgtcaagaggttagcggctctctcttcacagcggtgtcctgctacctgatggtaaattccagggcgcgactaaaatcgcaatcggctaacacaacagggtcgccttttctgacaataatgctatttgtgcccaggcattttcggctctgtttccccttaattttgttatcatcagtgagccagcgctggttatcattacccgtgcatgaataaagaatgattggcgtgccttctttcgtaccctgtcctgcagcatccagacatttctcaccctgcgtgattctgtctcggtgaaatgagaaaagctgagattgcacatgtttacactcccgcagcgtcaaacgattctgttgatctgggcctgtatcaaggcacagaccatcagttgtccgaatttgttccgcgtcatttatgtaataaccaccggaattaatttggttttgtgtaatgaccgggaacgacaaattaatactataaggtgcgggtaagccgttcgtcgtacatccacataaaatagaggagaggcagagaaccagtgtgttttttcctgaaagcaaagtcattcaattattaccctaaaaataaatagcattacaactatattggcaatttatacccactgaatatgacgtagcattgagcggcaataaagataattccgatagaatcacataaatacttcggttaaatgcgcgcagccagccactcctgcgacgatgggtatatagcgttaaatacttttgcaatattacatgctatcacagtgaaaaacggctgtacatttcttcacgttaaacaaagtgagaaggggggttgacacccgatatatgataaaagaggtcacaggagtcattagcaaaataaatcttttagattttcgccactgaaaacattctgcagcctttcaggcaaagcctcatagcagactgcggaggtatacgtactcgctaaatttttctgaaaaaatgccgggtgacgaattatgaaagataaacgttggcggcggtaggtccgcggagtccattaatacgacaaaactcaacgcgtataccggggataagagcttctgtttcgtgttggcgacatgctgaaatgtggacctgaacatctttgcgtccatcggagggggtgatgagacctttaccgctcttacaatcaaaggttttgacaattcctgtcattttacgagacaaacaaattccttaatggggataacgaggcgcactatacacgtcaggaaaaataatgccagctatatttgatggcaatcaagatttccggatggctaaaagtagtcgttcggcaccattgtagataaataacattatgttctggagaaagtattccctttcctggcgtcgttggttggtgcggacatcatgggttttgccgtcgggcaggatggtgaactaatctgcctggcttgctttttatcggtatttgtaggtggttgcggggttttactaccaaaatcgtagataaaaatttcccatgatgcctgttgtaaaccagaacaatggtctgaactggccaaaacatggaatgaaaaaataagtaatgaccaaagcataaaagcatgatgtttcatagcacctcctgttatatgtaatgacttgcgaagttcatctaattaattatgggacgtcattggcattttttattcaacgaagagttaaccactcttaataataatgggttttatagcaaaatagacttttttatcgagtgttcaatatttgcgtccgttattatttttctggaatgtaaattctctctcaacacaggtgaaatttatgtttgaattgtggtgttgattctattcttataacaagaaatgttgtaactgatagacatattaaaagattgaatcggagcgggaataaagcatgctgaacatcatggtgaataggattacggtgccagcgatggcatgtaacggcatttcgtctggagcgtcacgtgaggactgtgaagcacaatgcgatatgttctggttatatggcgagtttgcttaatgacatttttttagccgatcagcgtcaggcttcttaatgtggttgtgatatttttctttaaatatcaaaagtttgtatgacgtgtttgttgttttatagtggctaaacactttatggtttctgttaaatatatatgcgtgagaaaaattagcattcaaatctataaaagtgagatgacattgtagaaccggttaccttaatgagcgatagagcgcttcggtagtaaaaatatctttcaggaagtaaacgcatcaggagcgatagcggtgaattattcgtggtttgtcgattcggcatagtggcgataactgaatgccggatcggtactgcaggtgtttaaacacaccgtaaataataagtagtattaaggagttgttatgaaaaatattattttatccactttagttattactacaagcgttttggttgtaaatgttgcacaggccgatactaacgccttttccgtggggtatgcacaaagtaaagttcaggatttcaaaaatatccgaggggtaaatgtgaaataccgttatgaggatgactctccggtaagttttatttcctcgctaagttacttatatggagacagccaggattccgggtctattgagtctgaaggtatccattaccatgacaagtttgaggtgaaatatggttctttaatggttgggccagcctatcgattgtctgacaatttttcgttatacgcgctggcaggtgtcggcacggtaaaggcgacatttaaagaacatgccactcaggatggcgattctttttctaacaaaatttcctcaaggaaaacgggatttgcctggggcgcgggtgtacagatgaatccgctggagaatatcgtcgtcgatgttgggtatgaaggaagcaacatctcctctacaaaaataaacggcttcaacgtcggaattggataccgtttctgaaaagcataagctatgcggaaggttcgccttccgcaccgccagttacaaaacagggcttctttaccagtaacacgtacctgcctgtcttttctctcttcgtcatactctcttcgtcatagtgacgctgtacataatatctcaccagcataagcacagataaaggattgtggtaagcaatcaaggttgctcaggtaggtgataagcaggaaggaaaatctggtgtaaataacgctagatctcacaggattcactctgaaaaattttcctggaattaatcacaatgtcatcaagattttgtgatcgccttcgcatattgtacctgccgttgaacgactactaaaaagtagcaaggtatgtattttatctaggagagcaccttttttgcgcctggcagaagtccccagccgccactagctcagctggatagagcatcaacctcctaagttgatggtgcgaggttcgaggcctcggtggcggtccaatgtggttatcgtataatgttattacctcagtgtcaggctgatgatgtgggttcgactcccactgaccacttcagttttgaataagtattgtcttgcaatcctgttacagaataatttcatttattacgtgacaagatagtcatttataaaaaatgcacaaaaatgttattgtcttttattacttgtgagttgtagatttttcttatgcggtgaatccccctttgcggcggggcgtccagtcaaatagttaatgttcctcgcgaaccatattgactgtggtatggtccaccgggaggcacccggcaccgcaattttttataaaatgaaattcacaccctatggttcagagctgtgtttttacatcaggtgggcaagcataatgcaggttaacttgaaagatacgagcaataacagaaaccagtgatttcgtttatggcctggggatttaaccgcgccagagcgtatgcaagaccctggcgcggttggccggtgatcgttcaataatgcgaatatgaatggttaccagccgctgcgaattctacctgggtcacttaataaagcaaaacatttaaacactcaacaacgacaattcagacagttcgaacttttctttaaaaataggattaaccatgtttaaaagtggttactaattagccattatcctacggtagtgattcacatattctttaacgttacgttacaggaaggttgaagtggaaatgcctgatgagccttcaggcatttctgaaggttagttagctaaggaacagttactgagaacaggtttatcatcaccttccaccagtttagccgttttgcctttggtataaagtttgtaagtataatttttgtctatggcttcgtaatttgctccggaggccattttcattaaccgcatcgggatcatctcgtttacctgactgataatcgcataggcgtttccagcctcggtgttgacgtaaatcacctccataacctggttatcattacaggtgtatatagatttagaaatctcctgcgaagctgctatagaggtggtactggcgctaagcgcagcgagaaagagggtaaatgggatcaatttacgtttcatcattagtatcctttgtgtataaaattgtcgttaattccctgaagagcgggagataaagcggcatcaatacgatgaatgctgtagtattcctgtttactgacgaaaagtgcgccagaaaagcgtattataatttatccatcactgacatatgtgatgagtagacaaatcttaaaatcataaactatagactgcaaatcattatggcgcgatggaaaatgattgtcaccactgctcaatactatggcataaaaaccgaagaaaacggtactgttcactgtctcgtttcatacggtatctgtcagtgaaactatttcttcaaatgatggtctttttattatcgatcagataatggcatcaacaggggttatttaggagtatatgtgaaaaagtggcttataggagggatattgatcgcaagttttctgaccggttgtctgatgtggcacaacattgataaatggtttaataaagatatcgaagttttctacgccggagacgataactaaaactcctgtcagttggcaacgggtgtcatatcttcaggtatggcgcccggagcagccgggcgcaaattgtaggtgtataaaagtcatttcattaaaattttagcgacaacatggacagtcactaccgcgtgctaacggccctctgaagtcacaagatgaataagccagttttttgtttcagcggtgactgaaacatattttgctcctggtgggcttaccgccagttgctgaaaaagacaacgatgatgtaactgttgcagagactgacgaatacgacgaccgtgagttttatttttggcgaccatatttcctcccaaaaggccgcccgaaggcggcgctgggtttgataatggagaagggcgttggtcactgccataaccaacctgtatacactaatgtaattgataatcattatcaattgtggtgatgaagaaaaattgtaaagatgaagggacagcggaaatggcaatgaacgggatgagatttttcgttaaccacttaaattcgtgactaaaaaaagtcttttataggcttgaaaatgttttttccgtccctatgtagtcagtggacaagcaatgcttgccttgatgttgaacttttgaatagtgattcaggaggttaatgatggcactcagaaccttgtcagcacttcccgtgtttgctgattctcttttctctgaccgtttcaaccgtattgatagacttttcagtcaattaacaggagatacgccagtcgctgcgacgccagcttacgatctgcaaaagcgcgatgcgaataactatctgcttaccgtgagcgttcctggctggaaagaggaagagcttgaaattgaaacggttggcggcaacctgaatattacgggtaaacacactgaagagacggtagaggatcagacgcactggatttatcgtggtattcgtaaggcagatttccagttgagtttttctttgcctgaacatgctaaggtgaataatgcaaaactggaacagggcctcttgttggtagagatttaccaggaaatccctgaaagcgagaaaccgaaaaaaattgccatagaaagcaaaccaaaggcgattgaacataaatcataaaagcattaatggaggcccgtttagacgggccttcattgtctgtagcgaaaagtatcccgtcatgcttgtaggcacagatcgctaaatattatagccctgacctctatattatcccgtgccactgacctcgtcgccattggacggcggtaagttggaattatccgcgaggtcagtccaatttttgtccactctcgacattctgcctgttatgggcgcgatacctgaacataaattcgtatagcggttgatcgttttcaccgcgttgatgctatttctgctaacactactttcatacgtaaaaaagctgatgctttttaccttatttaatagaggcaggtatgaaattagcgctcgtcaatcgacaggtcattttaccggaaagcggaaccgagtccttccagtgccatgcctctacgcttgttcgcctaccgtgcggtacgctcgtggccgcatggttcgcggggttgtgcgaaggaagcgaagatacagccatctggctatctcgctatgaacataatatctggacaacaccgcagcgagtggcggcacgcgagggggaagcgcactggaatccggtgttattttacccgtcggataaattgtggttattttataaagtaggcagcggcgtacacgtgtggaaaacctggtttatcacctccagcgatcgaggatttacctggagtacgccagctccgttggttaacgatgatattttgccgcgcggtcccgtaaaaaataaactcctgctggcatcaaatggcgcctggattgcgccagggtcgattgaaagtcctgaacggtggagggcatttgtggatcgatcctctgacgaaggaaaacactggaatatctcttttgttccgctggagcctgataacgctatttccgggacaaacgtagcgttgtgggatggtgtaaaaaaggggatgttgtgggaatgttgtctggaaaacctcctgcgctgggatggcgttattcagcctacgctgtgggagtcttctccggggcatatccatatgttgttacgaagcacacgcggggcaatttttcgcagtgattcaatcgactatggcgctacctggtctgttgcccgcgcgacatttttaccgaataataatagtggtatcgatctggttagtatgcaggacggtacgctgattcttgcgttaaatccggtcaacggcaactggggaaagcgctatccgctttcactgattgcttcccaggataatggcgaatcatggctaccgctactggacctggaaagtgaccacggtgagtattcttatcccgctattattagcaagggcggcgtcgtacatatcacctacacgtggaaccggaaaaatatcgtatattgtcgattacaaacggtataaggcgctatcagtcgaaaccgatagcgctggaataataatgccttgcccggcgtgctctctcacgtcgggatggccgaaatagtcatgatttaccgggtaacatccttgaaaatgtatcgtctttttgtatgtaatggtgaaacaacgccgctgctgcatgcatggcaatcaggaaatagccgatattggccagcatttcatgaatacgctttatatccgattttagggtgctatctggcgtcaaaaataccggtacagtaaaaccaaaaaagctccagcttttcccgcctgatgccatcatcgcgacgcccagcagcggtaaggcgagaaaagtgagataaagcgcgatatgcattaatttagcggctacgtgctgccagtgaggagggggaggcgtaatgaccggatccgggtatttgtgtttaagatataaccgtaaaaacatcagcgcccagaccagaacgcccatgtcatagtgcatgtctttcataaataggtaaacgctggagccttttggcgcccacccccgtaactcaatagccgcatatgctatgcctgtcaggagcagtgttaaccagtgaagcgttatttgcagtcttgagaaatgtgccattattattatcctttattaacaactgcttgtagggtatgcgtaaaatcttaacagaaccttaaagcgggggctgagtcgcaaggaacagacagagatagcggcacgtaaaatgggataaaaagccggcggcatcgccggcttactgttgttattgtcctcttacgacaacacaggttttaccataaaacggatatgagcctgtagtttcataatcaacactcgacactaaagaaatatcgcccgcttttttcgctgaatcaatagatgcgtcgccggtatttacaatacccaataccgtttgcgcacacgctttaccggttttggttgccgggagactcgtggcagtaattggccctttaacatccgtatataagccaatccctgtcggtgatggtcctgtagcacaccccgttaaaagagaaccaataaagataattgaaaaaatgtgttttttatttgtcatgggattagtccattataaattaatagaaaacttaccgtccgaaaatgtccggacagtcatttaaaaagtggtgtatattaaatatgcgatattactctttgcaccctcctgttgatgtcgtacctgatggacaaatatccgttgaagccggatatattccccatgccgtgtttttataacttgcgcatcctgtcagcaatgagaacagtacggctaaaaaaatcatcacgagccctggcggcgttaacatttttcggttggactccatagcatgtcatttcatcgggttgccatatgactggcgttctgctggtaagtttcattaacgcctggttcgtttaatattggtttaggtttaaagccaggaagcgctaattacgataccttcttacgtttcagtactgactaataacgttgagaaaatgaacagcgtcggatgggaagacgtaatacagaatagaaaggaaataagagaataagatggcgttaattaacccggtattcctggcgtcatttcccttgcgttttatccccgtcaaaagtggcctttagcccacgttggcgctcccgacgttgacaaccagtgagtgtccatagtgtgcgtatgatgtttttaaaagatcgtcatactttctgttctgcatcaattttttcattacaaatgctcgccataatgccgtcctcaggaggtctcccgacgtttatgctgcgccgggagaaacaaaaacaacgcataatctgggacaaattgatgattaaaggcaaactggcgctcgtgacgtgcgcgctgactctggtattcacttcgtcgcttttcgccgcgtcggacacggcagatggtcgtaccctgaagctggccattggccctgagccaacggaaggctttgatcccatgctgggctggagccacggcagctacttattgcttcatgcgccgttgcttaagcaaaacgccgatatgagttggggtgatttactgacggaaaaagtggataccagccccgacggtaaaatctggacgctaaccttaaagcccgggctgaaattctccgatggctcgccattaactgccgaagatgtcgtttttacatacaataaagcggcgaagagcggcggtaaaattgacatgggcaattttagccatgcgcgagcgctggatgcgcgccgaattgagatgacgctgagccatccgcagagcacctttgtgaatgtactcgggtcgttagggattgttccggccagccgttatgatgaaaaaacgttcgcccgcgaaccgataggcgccggtccataccgactggtcagctttcagccgggtcagcaactgatcgttgaagctaatccctggtatgcgggtaaaaagaatgactttaaccggctggtttttgtctttctggatgaagataatgcttatgccgccgcgcgcagcggacagttgggactggtgcgcattgccccttctatggcggtgaccccgcagcaggataatcttaaactctgggtacgcgatagcgttgaaaaccggggcattgtcttcccgatggtgcctgccggtaaaaaggatgctaacggttatcctgtcggcaacgatgtgaccgctgatgtcgctatcagacgcgcaattaactatgccattaatcgtaagcaactggcggaacaggtgatggaaggccatgcgatacccgcctatagcgcggtgcagggattaccgtggcaaaatccttcagtggtattcagcgatggcgatattgcaaaagcgcgcgccatcctggaagaggctggctggaagataaacagtgcgggcgtgcgtgaaaaagcaggtaaagaagcgcgtctgaccttatggtatgccagtggcgacagcacccgacgggatctggccgaggcggtgcgcgccatgttgcagcgtttaggcattgtcgtctcgttgcaatcgggaagctgggaaactgtagagcgccatatgcacgctaaccctacgctgtttggctggggaagtctggacccgatggaactcttccatcactacagtgggaaagccgctggtgtggaatattataacccgggctattacagcaaccctgcggtagaagcacatctgaagcaggctatagatgcgcctgactggcaaaaggcgatccctttctggcagcaggttgagtgggatgggaagcagggcgcgggcgtccagggcgatgcggcatgggcatggctgcttaatattcagcatacttatctggccaacccctgtattgatctgggaaaaggctcgccagaaatccacggtagctggtcggtgttaaacaatcttgatgactggacctggacctgtcggtgatgaaattgttcttcagtcattttttgcggctgattattctgttggtgctggtggctgccggcaccttcattttgcttagcttttcgcccgttgatcctatccgtgcttatattggcaacgatctgctccatgttccgccagaacaatatgcgcggattgcggcgcgctgggggcttgaccagccgctgtgggagcgtttcggtcactggttttggcgtctgctccagggcgacatggggtattccatgctgttcaacatgcctgtcgccagcgtgatccgggaacgttttgcgacgtcattcgcgctgctggcaggcgcctggctattgtctggtgtgctgggcgtaacattgggttttctggccggacgttttctccaccgttggccggataagatgatttgccgtatcagctacttattgtcatcgttgcccactttctggatagcaatgctgttgctggcgctgtttgccgtccgctggccggtattacctgtttgttgcgcctgggaccccggaaataatgcaggaacagctcttttatcggaacgtttacgccatcttgtgttgccggtatgtgcgttaagtctgttgggcatggggcaaattgcgctgcatacgcgagaaaaaatagccagcgtaatgaagagcgaatttattcgttttgcgcgcgctcagggggataaaggatggtcgctgttacgtcaccaggtgttacgtcatgcgattaccccagcgctctgcttacagtttgcttctctgggtgaactgatggggggagcgttactggcagaaaaagtctttgcgtatccggggctgggacaggccactatcgatgccggcctgcgtggcgatgtcccgctactcatggggatcgttttattctgtacgctattagtgtttgccggaaatacgatttcagcctggcttgtggtggtgcttaatcgatcgctggagcgtcccgatgctctataatcctgccccgacgttgtttcgtctgctcctctccgttacctgtctgctgtttattgccggatacggttatgccacgttgagccagccgccagaggttaatctgcttgcccggcatctgtcgcctgatatccagcactggtttggcaccgataatctggggcgcgatgtatggcttcgttgctttcagggggccttcaccagtttacaaattggcgttggcgccgcgctgtgcagcggcgttatcgcgttagtgatggcggcagtggcgcgcattcatccccggctggacctcctggtgcggctgataaccgatgctatgctcgccatgccgcatttacttttgctgatccttatctgttttacgctcggcggcggtaaaagcggcgtcattgcggccgtggcgttaacgcactggccccgtctggcgctgattctgcgcgccgacgcggagcgggtagcgcagagtgactacctgacattgacctatcgtctggggcatggacacctttattgctggcgatatcactattttccggcgctattgccgcaatggttgacgggaacgttattgatgtttcctcatgcggtattgcacagcgcggcgttaagttttctggggtttgggctggcgccgcatgagccttcgctggggctgttgctggcggatgcgttacggtttattagccatggaaactggtggctggtgctatttcccggcctaatgttattcacgctggtgatgctcttcgatcagtttgcgcgcgccattcagcggctgtggctaaggagtgacgtatgctgagtttacaacgggttacgctggaaagcgcgcgttatcgctggtatggcgcgagacgctggtcgccgttattacagaatgtctcttttgatatcgcgcccggcgaaatggtggcattggttggcggcagcggggagggaaaaagtctgctgctgcaatgcctgctcgatctgctgccggaaaacttacgttttcggggtgagattacgcttgatggcaaccggctggacagacataccatcaggcagcttaggggcaatacgtttagctacgtgccgcagggggtacaggcgcttaatcctatgctgaatatcagaaaacatttgaacagagcatgtcatctgaccggacgcgcctgggatgagacgcagatggtacagttattacagcaaagcgatcttgcaccgacagtcctggaacgctttccccgccagctctccggtgggatggctaaacgaattctggcgtgccacgcctcgctcagccaggcacgttatatcctcgcggatgagatcaccgcctggcttgatacggcactggcaaaccagttgcttgagcacttgcgaggtctctgcgagcggggatgcggcgtgctgtgggtgactcatgacctgctgctggcggcgcggtatgccgatcgcattgtggcgctgcatcagggttatatcacggacaatattcgctgtgaacgattacagccggaagagatgagtgagccgttaaaacggcaatggcaggcattgcctgaactaaacccgttatttatgccgaccggagagggaatagaatgctgagctgccgcgacctcgttattcgtcagggcgggaaagtcttatggcagaacctgacgtttacgatttctgccggtgaacgggtaggaattcatgcgccaagcggaacggggaaaacaacgttggggcgcgtcctggccggatggcaaaagccgacgacgggcgacgttctgctggacggcagcccgttacccctgcatcagtattgcccggtacagctggtcccccagcatcctgaactgacgtttaatccctggcgaagcgccggagacgctgtgcgtgatgcctggcagcctgacccggaaacgttgagacgtttgtatgtgcagcccgagtggctgacgcgtcggccaatgcagctctcaggcggggagttggcgcgtattgcgatactacgcgcgcttgacccgcgagcgcgttttctgattgccgacgaaatgacggcgcaactcgatccgtctattcaaaaagcgatatgggtatacgtgcttgaggtgtgccgcagccgttcattagggatgttggtgattaatcatcagtctgcgctacttgatcaagtctgtacccgccatttacaggtggaatagccgcaagtcgtttctccgcattgtcgtgtcgccgttaacgcaccgggagcccatgggttcccggtattgtcggcagagattttactgcatgacgcgtttatctgcgttttttgcatcagcggtattactgtagtccctggtctcttcaacctgtacaggggctctgacgaccagacttggcagcgccagttcgatatcattctcaatgagtttttcaataatacggatatttatctcttgctgaatatccatgtatttattgtaatccgcggtattgacgatatgtaccacctcataggtcagccgatcctgaccaaaggccagtagatgggcgcggtcgaattgtgtttcgccgacatcggtaataatctttttcaccatatcgccgatgaggcgtaacttttccggcggtgtcgcagtggcaacgccaaaagtaaacacgatacgacgcgtttgcatccgcttatagttgtgtatggtttgctgcaacaactgcgcgttcgcacaaacgatctgttcgccgctgaggctacggatgcgagtggttttcaaaccgatatgttcaatcgtaccggctacatcattaaagacgacgaaatcgccgatctcgaagggcttatcgaaaccaatcgacagcgaagcgaagacatcgctcagaacggtttgtaccgccagggcaatagcaataccgcccacgccgaggctggctaccagtgcggtaatatccacgccgacgttcgccaggatggagagcaacatcatagaccagacgagcacgcgcaaaatcataccaagaatgactaacgtcaccgggtttttattggagcctggggcatacagtaaatgacgcatccatgactgtacgccctgatcaagccaaatcgccatttgaatcgcaaccactaaaaaccaggcgtgagagagggtagagaataaccggtcgggcagggcgacaaagcgcaggctaaagagaaatgcggcaaaaaagatgagcatcttactggtctttttcagcatctcgaaaacaataggccgcagccgcccatgagcatcatcctttttatccgggcgttgtagcgctttatagaccacattaagtagccagttgatgagccagtaagtaatgagggtgacgaaaaaaacgaccgccagattgatccagaacgtcgttgacatcagcatcgcaacgatatttagtcgtgctaaatactccattttacctccgatgaaaagcagatgaacattacagtatagacgtcacatcacggaggccgatttccggctttactattgctgttttattcagcacttttgttcaaaaagcatgaaaaagaggggtagccgtttggctatcccggcgtttctgtgcagacttatctactcctcttaataaaataaggagtcatttatgcaacaagaacatcgagagtgtattgagcagtgttatgaatgcgcggcggcgtgtgatatctgcgcctcttcttgtctgcgtgaagataacgtcgaaatgatgaagtattgcatcgagttagatatgcaatgtgcggccatttgtcgcctggcggcgcaatttatggcattggaaagcgagtactcacaaaaattatgccgcctgtgcgcggatatctgcaaagcctgcgccgaagagtgtgcaaggcacgatcacgaccattgccagaattgcgcgcgggcatgcagccaatgcgcagacgcctgccttaaaatggccgcgtaatttttcttccgccattagctcaaccggatagagcatagagcttctacctctaaggttcggggttcaattcctcgatggcggaccagttgatatcaaaaaaggccacctgcgcggtggccgctgagtttctgttgaaataaatgcaatgttataatataacaatcatctttctaagaaagatgagggtaacgttttggtgattcatttaaaaaaactgacaatgcttctgggaatgctgttggtcaatagtcctgccttcgcgcatggtcatcatgctcatggcgcgccgatgacggaggttgagcaaaaagcggcagcgggtgtgtttgatgacgctaatgtacgcgatcgcgcgctcaccgactgggatggtatgtggcaatccgtctatccttatctggtcagcggcgagctggaccctgtcttcagacaaaaggcgaagaaagacccggagaaaacgtttgaggatattaaagcgtattatcgcaaaggatacgcgacgaatgttgagactatcggtattgaaaatggcgttatagaattccatcgcgacaataacgttgcatcctgtaaatacaattatgccggctataaaattctgacttacgcatcgggtaaaaaaggggtgcgctacctgttcgaatgtaaagatgcgaatagcaaagcgcctaaatatgttcagtttagcgatcatatcattgccccgcgcaaatcggcgcacttccatatctttatgggaaatacctcgcaacaggcattgttgcaagagatggaaaactggcctacctattatctttatcagttaaaggcgaatgaggtcgttgacgaaatgctacatcattaagtctgattgcaatgttaaaagctcgctatgaatagcgagctttttttctgccgttatgccatatttctggcaatcaatataaaaaatacctgcgcccccggagcaacgatgacgctgtccataccgccctcgattcaatgccaaacggaagcggcgtgtcgcctgattactcgtgtcacaggcgatacgttgcgtgctattcatttatatggttccgctgtcgcgggcgatctgaagccaaacagcgacattgatctgctggtgacaatatgccagccgctgacggagacccaacgcgcaacgctgatgcaggaattgctggcgctttcatcgccgccgggggcgtcagcagaaaaacgcgctctggaggtcactgtcgtgctttattcgcagctggttccctggtgttttccaccttcccgggaaatgcaatttggcgagtggctaagagaggacatttatcaggggatttatgaaccagcgcagcaggactgggacatggtgttactgataacccaaattctggaaaccagtataccgctaaagggagaacgcgcggaacggctgttcacgccagcccctgcggcgcagttgctgaaggccttgcgttatcccctcgacctttggcaatccacggcagatgtgcagggagatgagtatcatatcgttttaaccctggcgcgtatctggtacaccctttctaccgggagatttacctctaaggatgcggcggctgactggctgttacctcagttgccagaagagtatgctgctacgttgcgtgcggcgcagcgtgaatatttaggtctggagcaacaggactggcatattttgctgcctgcggtcgtacgctttgtggattttgcgaaagcgtacatccccacgcagttcacataagatgccccaggacgtctgtcaggttgcgcaaacggcgttcctcaactactacttaataggttctcatcgctgaagtaagcagatgatcttatgcgggccatcgaatggatattcccacatggctctcgttttgttgaggtggatatgactggttccgcatcatctgttttaaagacagatacaagactattgagcgaaaacctgtttcttaattatggtctggagtccttatttaaggacgtcgcaataatagctggcaacgtaaattatattgtttttgatatcgacgattactacaccgtacagcagtatattacttccacatttaaaacggtactcattgggattgttacccataatgaatataactttattgatgaacatcatgctatatatcgaataaaggtcgatgcctctattgctgagtggcgcgaattactgattttggccgctgctggtcaattttttcccagatcagagaaagtcagattaacggcgaatgaaagaaatgttttggcgatgcttgttaaaggaatggatatccgacaaataagctgtgagctgaatgtacatttaaaaactatttactcagtacgctaccatgtcctgactaaattaggttgtagaacagttctggattatcaaatactgtccgtctctaaagcctttacgcactggcttacaataaataatgtcgataatgtaattttccgtgtaaatagcaaggtcattgcttaataatgatttgcttctgatggcgtttaggttcactatgctttcttacatcatcatgaggccagacaggcatggctacttttagtattagcgcaatggcggcgcagtgtggtgtcacaacagcaaatatcaggtcctgggaacgctatggcctgcttcaacctaccaaagatgaagctggcaatcgtttttattgcatagaagatgctatcagaatacagcatattatcgacgcgttaagcaaaggcttctcattaaaagagattaaacctgccctctatggtgaagaaacgcattgccgctcgggatggttattctaccaggaagagattttagcgcagtgtagaaaattcgaacccgccaaattgcgaaaattactctggcgttatggtcgggaaattccgccgtgtatcgtaattgagtcaatactgcgtcctttatggctgtggttgtccgcaggcgatgatgatgcacgccgatttgaaaaggcattactggatactgcgattattgaatacgccacgttccagctaagtagcgtacgaaaggcgccagcaggcacaatgcttattgctgcgttttcgctgaacgaccccattgagctatggctggaaacgattaaatattgtagtgaaggtatgcgagttgaagtcatcccctggcaggcgccgatgcccgatcttttatcaacgtctttcgagcatattgttttgtggcatgatgagacattaactcccgcccaggaaaatcttattcaggctttaaaagaatcgggtaaatttagtcttcatgtgaaaaatggctcaggcttaacattactgccagccgtataccggcagcatgagatgcccgaaagcatgcagcatgttgcaccgcaaatccatgcaaacggctacgaaaaatcaggcaccgcacgttgaggcatctgcattattaacgaacaggggaggagtaaccccctcccttgtttatacccttcatacttcaagttgcttatgtgttggctacggattactcggcccatccataggcctcgccctgacgggccgtcgcaagcgacgttcaaatctgctcccggcagatttgtcgctcaccccagtcacatagttatctatgctcctggggactcactcccttgccgccttttagcaacacgaattattttgggtatatattagatgtcgtcaggtgtctgaaaaaaaacggcttctaaggcattgcggtaaatatcaagctgcactacgtctttttctgtttccagtttttcaataagtttggcgatgatatccttatttgagacatgctgctgcgattgcaatagttcgtaagtaatttcctgaatagctcgctgttcacataacatatgtgcagaaaaaggattgccagtactattttgttcgttgactagtgtaatggtagtcatatttcaccatattcgatgtaaattgaagccgatctccctgagcgggggagagaaattagtgacctattaaagttagacctatatcataaaactgtaataaaaaatcataaaaacgtgatgtgcatcacatttgtgtgatttgttgtatattttatacactttaaatgaaggtgaagattccgcagaatcaacggcctgttcttttttctcactccagtttaaacgaataagcattaatacccatctgtaataattacttaatgttatcttaataaaggtaaattactgtcagacctccgtaaaaggaggttgattaatgattcgtcatatcgccatttttctttgttctttattgatgtgcagcaccacttttgccgattcggtaacgtcggtatcgcttggcgcgctcttaaccgcgctcaatgaacgcatgttattaatgaaagatgtggctgcttataaaatgaagcaccatctgccgatagaggatttcacacgtgaacaaaatgtttttgccgaggctgaagaagaagcgaaaaataacggtctggacccgcattcgataaccccttttattcgttcgctaatggatgccagtaaagcgatacagtaccgctatttagcgcagtggcgaaccggctcagaaccctcctttccgatacaaaccttgtcggtcacccggcaacgtattcgacaacttgataatcaaatgttgatcattatcagccagcgcctgatggtcggcgctttcagccatgaggatatggtgtggctgagaacgcactttaatgcgccgaatctgaatgagagcgatatcagtgatgtgttggcagccctatctttggtgcgacacgcgcgttaatcccccatgaggaaacgtgggccaatacctggtgattgcctgcgggggcgcgataaaagaacgtttttgggtgatggggatataagcgtggcggaatagcggctggagagacgtggtttcgcttcccatcttccgatgcattcgttagcatactgtttcgcagctaagcgtaaatgttttcaggaagaggttaatgtgttcgcggagtatggtgttctgaattattggacgtacctggtcggggcgatttttatcgttctggtaccagggccgaatacgctttttgtgcttaaaaatagcgtgggacgcggggttaaaggaggatatcttgccgcatgtggcgtgtttatcggtgatgcgatattaatgtttctggcgtatgcgggcgtggcgacgctgatcaaaacaacgccggttctgtttaacattgttcgctatctcggcgcgttttatctgctctaccttggcgcaaaaatcctttacgccactctgacctcaaaagggcgtgcggcgacggaaacggtagttccttttggcgctatttttaagcgtgctttaattcttagcctgacgaatcctaaagccatacttttttatgtttccttttttgtgcaatttattgatgttactgcgccgcatactggggtgtcattttttattttggccaccacccttgaaatcgtcagtttttgctatctgagctttttaattctttctggcgcttttgtaacccactatattggtaccaaaaagaaactggcaaaagtgggcaattcgttgattggccttcttttcgtcggatttgccgcccggctggcaacgctccagtcttaaccccctggacccgtcgtgaacggcgggtcattgctctcctttcggttttattgcgtggaaaacagcaaaatagtaaccaataaatggtatttaaaatgctgtttttggagcgtaacctttttacgacagcgatgagattatcgctgagtaacctgcgggaagagggaagcaaatgcggcaaattccacaaaatcatatccatacacgttccacgcccttctggaacaaagagacggcgcctgccggaattttcgaacgccaccttgataagggaacgcgacccggcgtttatcctcgcctctcggtgatgcagggggcggtcaaatatctcggatacgctgatgaacattgctctgagccggaagagatcatggtgatcaatgccggcgagtttggcgtgtttcctccggaaaagtggcacaatattgaggtcatgacggatgatacctattttaacatcgacttttttgtcgcgccggaagtactgatggaaggggcgacctcacgaaaagtcattcatgccgggagagaataataatgggaaaagctacttataccgtcacggtcacgaataatagcaacggcgtctctgtggactatgaaacggaagcaccgatgacgttgctggtacctgaagttacagcagaagttgtgaaggatttggtcaataccgtgcgttcctacgataccgaaaacgaacacgacgtttgcggttggtaaagatgctgtagtatctatttgatataaaatgattctttaaatgagaagccgcatcgcgcgtcgccagcgtgatgcggtttttgcgtattgaaaagcgctgtttatttacatcagacatgggttgaaaagaaacattaagaaaacattaagaatatcgcattgtttgctaatgagagcgtattcataaaacttatgattgggtattaaaaaccagaagagtcttatgatcatgaaactcgatacccgattaacttcgtcagcacttactcttgcgcttgccgctgtggtcatcccgtttacggcggactggcaattgcctttgcttaacggcgtggtggtccgatggattgaaaacggacaagcgttatggttactgtttggggcgctatttaccgcctggtatatacggccactttcccgtcccgaaggggcaaagcagttttggctatgggctgttgtctggtgggtggtgctgttgggtagaagcaccagttgggggcgtgactatttccctgacgagccgcgtatgctgttcagaacgatttcagtgctattaattgctgcgttggtattgccagtcctgttttttgccgggctacgtaaggagattgttcgtcgtctgcgggacgttcctctgccattgtggctgtttaccgtgacggcatgttcatatctgatttccgacactgtcgagcatcatcggtggttgtcgccgatattcctgcataacgctcgttacacagatttgattgaagagctttatgaagtgccatttatgatcggtttgtttatggtgaccgtggggtttatgcagcaggacaagcaggatgaatgtactgcgctggagctgaccccgtatcacgcaaaatagcgcggctgaaaaagaccatgaattcgatatgggatagatagcagttagcaaaaaaagcccgcactcggtgaggcgggcaaataatactggaagcaatgtgagcaatgtcgtaccgaacaggtgggttataaactcaaccactcggtattgataaagataatcgttatcattaatgattgcaaccctgatatttatgcgcttttatccacgacgctaaaaggtgatggatatcacaaacttcactttcctgacgatgtgctattctttttaacggcaaataaaccgctaacgttaagacataagtgaggaaaaaatgggtattctttcatggattatttttggacttattgcgggtattttggctaagtggatcatgccaggtaaagatggcggcggattctttatgacgatcattctggggatcgtcggtgcggtagtcggaggatggatcagtacgttctttggctttggcaaagtggatggtttcaacttcggcagctttgcagtcgcggtgatcggcgcgattgttgtgctgttaatctacagaaaaatcaaaagctaaacgcagaactttcagagataataaaggctacgacaggtagcctttattattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattcaaaatgaatttaccaccagcccagttcggtacccgccaccgcaattagcgcgatgcccatcaacaccatcgttgttttcctcatggttatgctcccggtgcggcgtaaccgccaataaaaaaccatgccaaaaataatattgccgtaatgaaaatgacgacagggaagaggacacccactctcatgctattaccttcactgttcagggggcgccagaatagcagggttttctcagcgacaaaaggttggttgctttgtgacagggcgtggctattgctgacttaacccgggataaacacccactaaagcgctgacagaaagtatggaaatagcgtacccgccaggttatcctggacaaaatatcgctttaaggagtcgttatgaaatttacgtggattgcgttgccaggcgtattgctgctgagcgcttgttcatcgtcgcaacccaacgcccccaggccgccgcgtattgggatgcctaatccggcagccgtctactgtgagcaacagggcggtacgctgatgccggtgcagaccccacaaggcgtgcgttccgattgcaaattgcccaatggcgaaatcattgatgagtgggcattatggcgcagagagcaccctgatacgaaaaagtgacaacctgcggtccgacgggatatgattaagaacaatctgataatgagtttcatgcggcgcaagaaaatatgtttcagttaaagccgggcgcgttggcaatagttattggcgctaagacacccgccggacggcggaatattggtaaatcggttgagctattttgcctgtgccaacccggagatgaattcattaatccggtaaatggacacgtcaccttactgccgaaagaagcgcctcgggcgctgtggctggttacgggcgacgtagcctccgccgatggtcagcacggttttgcctgggtgcgagcagaacatttgatgccgttgtccccggacagacaaccaggccaggcggcggcacgacaatcacagctctcgtagccactctgccagcacaatggcatggttctggcgagtatctttagcggcgtatagcaacgttagcggttggtgtcgggcaatatccgccagacgtttgccttcttgatgctgttgcgcaagttctgcccggtattgctgcgcgaagtggttaaaatcaatcagttcgctatgaaaggctttgcgcaattcggtggagggcgtaatggccttattccattcatcatagaccagcgctgcttttttaatgcctcgcggccatagcctgtcaaccaatacccgataaccatcgtctttttccgccgggaaatagacgcgcttacactggattcgcatttttccctcctgtgatggtgtcgcttacggtacttttgtcggatagcagtaatgattttaatggatcaggcctgataaacgaagcgtcatcaggcattcaagtgggtatcaggtttatttatgacgctatctctcgatcgcgtccggcgtagaggccgaaaatcgccatgatgatagccagaaccgttacgcccgatagcggcagataccagctaccgctggcatcatgaagttttcccatgacgggcggcccacatgccgccagtaaatacccgaccgactgcgccatgccggaaagcgccgccgcctgatgcgccgaactggcgcgcaggccgataaacgtcaggccgaggatcatcgtcgcgcctgaaccgaagccgaacagtagcgtccagatgatcgcctggcccagcacaaaccaaagccccgccgcgcccagtgcgcacaatagtgagaccagcgcggcaatccagcgttgaacgttaaagcgatgcaaaataagcggaatagctaacccaggcgccgcggtcgccagttgcagcaggccatgtagcgatcctgcctgtgcttcgctgtaaccgtggctgatgagtattgttggtaaccagccgataatcacataataaatcagtgagttaagcccaagaaacagagtaacttgccaggctaaaggcgaacgccagataccgcgttcatgtaatgcccgggagctactcaggttagctgagcgggtagtgcgccactgcggcaaccagataagaaacgccaacagcggaaacagcatcagcattaacagcgcgctgcgccagccaaaaccgtgcaacgccagcggaaccaccagcgcagaccccaacgcggcggcggcgcccatcgtcaatgagtacgcgcccgtcagcctggcgacatgttgtgaaaaatcgcgcttaatcaatcctggtagcagcacattacccagcgctatcccgcacccaataatggcagttccggcaaacaacaatgcagcggagggcagggagcggagagcaatacccgcgcaaatcagcagcattgcggcaaacagactgcgttccatcccaaaccggcgggcaataccggccgccagcggcgaaatcagtgcaaacgccagaagcggcaaggttgttagcaggcccgtctgggcggtggaaagaccgtaatccgtacggattgtctccagcaacggcgcagcgccggtaaatgttacgcgtagcgtagtggctatcatcaaaataccggcaatcagtaaagcgccctgtttgccgcgtggtgaaagggctgtcgtcatcgttttctcatctcgtcaggcgaggcgataccttaacagtttttactgtttggatgaatcaagctaaaatgacaatttatcgctaaaatcggacaatataatgattggcctgagactggacggttacgatcccgaccttcaccacgatgccgctgtggccttttgtattcgcgccagggatgatgaactgtttagccctcgccatcagcatcgcaagggacagttgatcctcgctctgcacggcgcgatcacctgtgaggtggaaaatgcgatgtggatggttccgccccagtatgccgtctggctccccggctcgctgccgcacagtaatcatgtgaccgcaggggcggagctgtgctttttatttattgaacctgcggcggtcgtcatgccggagcgttgctgcacgctgaaaatttcgccgttatgccgggagttgattttgtcgctggcgcgcagaaccgattccgaaagagcgcaaatgccaacgcagcgccttattcaggtgttgtttgatgaactgccgcagcagccgcaggaacaattgcaattaccagtatcggggcatccgaaaattcgccaaatggttgagacaatggcgcaggagcacgcgcgatggaatacgttagggcagtgggccagcgtattcgcgatgagcgagcgtaaccttgcccggctggtcgtcaaagagacgggactcagctttcgtcgctggcgtcatcaattacaattaattctggcgctacaagcgctgatcgcgggacgtaatgtacaacagacggcgcaaatgctgggttatgattctaccacggcattcattacgatgtttaaaaaaggcctggggcagaccccaggccagtatctgacgggcgagttactgctttcccacaattaaagagaccagccccgccgcaatcagtgggccgaccggcacgccgcgaaacagcgcgacgccaagtaccgtaccgaccagcagcccggcgacgagctgcggttggtttcccatcagcgtaatgccgcgaccacccagccaggagacgaaaacgccgacggcaatcgcgaccagcgatttccagttcacaaaagagtggatcaatgtggagggcggtagggttccgctggcgatgggggccatcacgccgatggtcagaatgataatcccgacggtgagcccctgtttttcaatccagggaaaaaaggtattcaacggggttacgcggacaataatcagcaccagaattgagacggcgacagtggtgttgtgactaataaatcccagagctgccagtccgagcaggatcagcagagtgacatcaaacattatggtttccttgccaaaaagtaagcctgactactttacgcccaaacggcaaagcgcacaggcctttttaacgattgatgcggatttcaggcaactgcctgaaagacaatttctacgtgaaaaacggcgttgtcattaaattgacatcaacgccgcgtattgctaaccggtgaaccgtcattgttgtcttcctgaggatacaattatgtacgatccaccgtttcttgaagcgctgatgataacagcgtcgtttttcgccatttttatcattattgttgtgtctgtattgctccttgaaggggactaagccgttggcgatgactgaaagcggcggaagactgccagttctggtcgggcgatgcgcagatagtcctgtgtattcataatgactgatttttccagcagaccggcattaaaggcaatttcatcgaaacgctcaaacaggagcggatcggcgaccagtttcagattggggtgaaaactgaaaggcgggatcgcgccaaaaacgcagccggtcaacatatcgacttccgccgggctggcaagggaagcgcgtaagccgcccagatgtgaagcaagctgagagaggtcggcttgctgatcggccgccagaatagcaagaacgtgctggttgacgccgttgcctttgactttacagaccagcgcttttgcgccctggcccagcgcagtaccgcgtatttcagataccgcttcgcattttcctactgcttcatggctcaccacacgatagcgcgcgttctcctgggttaataaagccactaaacgttggtgtgtagcgacacccttcgcgacttcagccatttcggccatttcttcctcctggtacaatatgaacatttactgcgaagcactatgatgaacgatgttgtttttgttgtttgttcagatagagctgcgcatcggaagcctggtaggcatcattaatcgtatcattgggctgcatattataaatcccggcggaaaaatggactgtcttatccggtgcgataatctgcaggttacgaataatacgctccggcagatggatagccaaatccgccgcgtaatcaacaagaataatacagaattcatcgccgccgaggcgaatggcgtaatcgcttttacgaatcgatgttttaatcgctttcgccaacagggttataattcggtcgccttcctggtgccccagggtatcgttgatcagttttaacctgtcgcaatcaatagcgacaaatgtcaccggcgtcccggtattgaccaggcgttgcagtcgctgttccagcaccggtgttaatattttacggttgtaaagcccggtcatggcatcgctaatattttcgcgtgtgacgttgcgataaagccgaaagtgcatccgtaccatattaagcaggagcgctgttgccagtaagtaaaaggccagcgctttccaggacgagacaaggaaataggttaaatcaagcgacaacgaaacgcgcagtccaccagggatatcatggttataattcacatattgaaacagattatttttgcttttattaataataatttcttttccggaatccagatcctttagtgttacgttaagataacgccaaaccagcggacggtcctgggtataaaaaatattttttaaattatcctggttaacatccaccatcacgatgccttttaacgatcccgacagatagactggcgttaaaaagctcatgacgttttcctgggtaatatcatccatgtagatacttgaaataaccgtacggccggtaaaaagtttatctatatcttttctgttaatacccattgtgcctttttgtaaaaaagtccaacgatgcatggcgaagcgccgtgagttgattaaatcatagaaatagacataatgtttatttaaatcaacgtaataacggaatttaagctccagtgtgcccagcccgtgactgtggtcgtcctgcgctcggttgatgcttaccgcctgatcaaatgcaggcagtaaaagggcgtcatcaagattatcggtacactgtgtagcgacggtttgcagggtgccatgtagcgccggataattatgccgggtcaggttgacgccgtgcgtaccgttaatggcctcaaaggcgtcgcaaaacgcgcggcgtttttctgcggtgacggggtctcccggcgcttcaaaagttcgcatcaaatgtgcggcgatgctttaattctggtacttatcgtacaaaaacgacgaatcggctctctccatgatataacgcatataggcattcattgccctgtcgctggcaataagttcgtaaatcaggaaggacgatgtcaaaacgatgacgcttgccgagataaagtgcctgagcgctttatgatgcaaattcatgatgaactacagccctgaaagtcggatgcgttagtttaccatagcgatgagaattcctctaacagactgtttaaaaataaaacgtgttgatgttatggaataaaaatcattctcgatttaataaattcaataatatatggtgttgatattttcagtcgtgactattgtcgcaaaaagtaaattgttaattaacggcatcgatttaacactaacgaaaataaaatagcctttattattacgtgaaaggagtgtgacgtggtaaggataataatgtacttccgttcggaggtactatgaaacgatttaaagaaatagcagcaattttgctttttgcattgctggccgtggggttcacgtcgtcggctatggcatcgtcgggcagtggtggtggcccgtgggattttgatatctattttcctggtcactactttttttgcaaactacaaccccctgattctctgcaattaccgccacctcctggtgagtattgctggcattaataaatccatactattccagtgataagtcggcgcatgtaaggtaaatccagtcaggagatatacaggtttacggctattgtagtggcaatatgtataatcgccttgttagtgataaatcagcccgtgacgcattacgggctgatttagggttatgcactttgattggcgctctgtttctgaaacaattcgcggaataccggataaatatcctcctgatcgcgaatatgctgcatggcgaagttatcgaacgtcgcctgcagatgttcatactcgcgccataaggtctggtgggcgcggcgggtaatctcgatatagctgtaatagcgcactaccggcagcagctttttcgccagaatctcatgacacagcggtgaatcgtcggcccagttatcaccgtctgacgcttgcgccgcatagatgttccactgactggggtcgtagcgctctttaactacttcgtccatgagtttaagcgcgctggagacaatcgtccccccggtctcttgcgaataaaagaactcatgttcatccacttccttcgcctgggtatggtggcggatataaaccacttctacgttcttatacgttcggctcaaaaacagataaagcagaatgtaaaaacgcttggccatatctttggttgcctggtccatcgaacccgagacgtccatcagacagaacatcaccgcctggctggagggctcaggtcgtttttcataatttttatagcgtaaatcaaaagtgtcgataaacggcactcgctcgattttagcccgtagttcggcaatctcccgacgtaaccgctcctcttcaagcagttgcgctggttcgctgtggctgatggtctccagttccgtttccagcgcgtgcagttcgcggcgttttcctgccgtcattgctgtacggcgcgccagagagttttgtagcgaacgtaccacgctgatattggccggcacgccgtttgaggtgaaaccggcgcggtgagttttatactcgttaagctggcgatgctggttttttttcagattaggcagcgctaaatcttcaaagagcagatccagatactcatcttttgaaatctgaaaaacaaactcatcctggccttcgccgtcctggctggcctgaccttgaccgctgccggaaccgccgccgccaccgctttgcggacgctcaatgcgatcattctggataaagtgatcgttacccggatggacgcgatggcgcagaccgccgcgcccctgatgaaacatcggttcgctaatatcatcggttggaatagagacggactctccgctgtcgacatcggtcactgagcgtttattaatcgcttcggaaatcgactgcttaatttgtgctttataacgacgcaaaaagcgctggcgattcaccgtgcttttatttttgccgttaagacgtcggtctatgaaccaggtcatatgccccccgtactgccaactgagcgcctgttctgttagtgccggatagcgctaacgcttagccagtctacagaacattactttgtaggcccggtaagcgcaagcgccaccgggcattaacatcacgacgatttacgcacgcgcaggtaccactcgcacagcaaacgaacctgcttacgggtataccctttttccatcatccgatcgacaaagtcgtcatgctttttctgctcgtcagtcgacgttttggcgttaaaagaaatgaccggcaacagctcttcagtattagagaacatttttttctcaatcaccgtgcgcagcttctcgtaactggtccagtttggattacggccgctattgttggctctggcgcgcaggacaaagtttactatctcattacggaaatctttcgggttactgatacccgctggtttttcaattttttccagttcggcgttcagcgactcgcgatcgaacagttgaccggtatctgggtcgcgatactcctgatcctgaatccagaaatccgcataagtcacgtaacgatcaaaaatgttctgcccgtactcagagtaagattcgagataggccgtctggatctccttgccgataaattcggcgtatttcgggatcaggtagcctttcaggaactccagataacgctcagcttgctcctgcgggaactgctcgcgctcgatttgttgttccagaacgtagaacagatgtaccgggtttgccgccacttccgcatggtcgaagttgaatacgcgggagaggatcttaaaggcgaatcgggtggagagaccgttcatcccttcgtccacacccgcatagtcgcgatactcctggtacgatttagctttggggtcggtatctttcaggctttcaccgtcataaacgcgcattttcgagtaaatactggaattttccggctctttcaggcgggaaagagtcgagaagcgcgaaagcgtttccaatgtgcccggcgcgcagggcgcatgagccagctcgctatgattaagtagtttctcgtagattttgatctcttcggagattcgcaggcaataaggcaccttcacaatatagacacggtcgaggaacgcttcgttatttttattgttacggaaagtcacccattcagattcgtttgagtgggcaagtatgatgccattaaagggcagggcggaaataccttccgtaccattgtagttaccttcctgagttgcggtcagcaaggggggcagcaccttaataggcgctttaaacatctcgacgaactccatgatcccctggttagcgcggcatagcgcgccagagtaaccatacgcatccggatcgttctgggcgtgatgttcgagtttacgaatatccaccttgccgaccagcgccgaaatatcctggttgttttcatcgccgggttccgttttggcgatggcaatctgctccagaatggagggccagactttcaccacgcggaatttagtaatatcgccgccaaactcatgcaggtgtttggccgcccacggggacataatcgtaccgagatagcggcgcggaataccgtactctttttccagaatctgcgcgtcttcctgcggattaaacaggcataacggatgatcgttgaccggactacgctcgccgttggcgcttaaaacataaattggcacgcgctgcattagcgatttcagccgttcagcgagcgatgatttgccaccccccacaggtcccagcaaatagagaatttgcttcttctcttccagcccttgcgccgcatgtttcagataagagacaatctgttcaatcgcgtcttccatgccgtaaaactcttcaaacgcaggatagcgagcaataacccggttggagaagagtcgggaaagtcggggttcctgggcagtgtcgaccatattaggctcgccgatagccattaatagccgctctgccgcgttggcataagcactgcgatcttgccgacaaatggtaagaaaatcctgcagtgtgaactcttcgtccttggcagcttcgtaacgctggcgatagtgatcgaatatattcatgatatgccattctttcgttttttcgcacatgttaagagccgttcatatgaatagtagaggctcccggaagaggtagactgaacgccgtctctgctaaggaaaaaaagcaactctcatgccattttattggtcagaagatcaacgtgtccggtgatacaccttcttaacattaagcgtagatggcatttgcaaaacttgcctgtacgcgtcagtgaatttcgatgacatatcaataactcatcaggtagaaaaggctggtggatatcagaaaaagcgttcccggccacataacgatcatcagccgatcatctgaaaataatcggtgatggtgatattaaacggttacattgtgtaaaatagttgggcttacaggtattggcggttacacttttgccgcagaacatttgaataaggaattatggattgtgaccaaacttaaacttctggctcttggcgtgtttattgcaacatccgccagcgtcgcgcacgctgaaagcaacctgacgttgggcgcaggcgttggtgtggttgaacacccttataaagattacgatagcgatgtttatccgataccggtcatcgcttatgaaagcgaaaacttctggttccgtggtctgggcggcgggtactacttgtggaatgacaatgccgataagttgtcaatcatggcatactggtccccgatgtacttcaaaccgggcgacagcgatgaccatcagttgcgtcgtctggacaggcgtaaaagtactatgatggcgggcgtttcttacgcgcaccacacccagtatggattcctgcgtacctcactggcaggggatacgttagataacagtaacggtattgtctgggatctggcctggctgtatcggtataccaatggcgggctgaccttaacgccaggtatcggggttgaatggaatagcgagaaccagaacgattactattacggcgtatcacgtaaagaatcttcgcgtagcggcctgcgcggctataacccgaacgatagctggaacccgtatcttgaactgagcgctaactataatttcgccggtaactggagcgtatatggtactgcgcgctacacccgcctgtcggatgaaattaccgacagcccgatggtggataaatcctggaccggtatcctttctactggcgtgacctatagattctgattgattgaatttgccggaaaaaccatgacaaagcctgcgttatgcgggctttgtgctgtctgaaacgcgaacatggcggcttgcataaatgcgctgttgaccgggtatggcgcagccttacgtgatttatactttgttacatcaatttaaaaaactagccttttatatgaaaaatccaggtgattacaactgcgctaacaattagcgtaataattgttgcaatgctggctgatatcgccctgtcacgtcccgcttatgctatacccattcttcacagcgagtaagacgaatgagcatagtattcaataccgtggccaagcccagcggcagtctgtgtaacttatcctgcaagtactgtttctatcttgataaaccccggggccagcgcgtcatgtctgacgatgtgctggagacgtatatccgccgggtaattgatgatacgccatcatcagaggtctcgttttgttggcagggggagagccgacgctatgcggtctttctttttatcaaaaagtggtgtgcttgcagcaacgctatgccaacggcaaaactatttacaacagtctgcaaaccaatggcgtattaatcaatgaagagtgggcggctttctttgtgcagcaccagttcctgattggtatatcgattgatgggccgcaagtcgttcatgataattaccggagaacgccgtcagggcgggcgtctttttcccgagtcgttaatgctatccgccttctgcaggcaaatgatgtcgagttcaatacgctcactgtcgtgaatgatgcatcatgccgtcatggcaacgctatttatcattttttgacgcaggaactggaaagtaaacacctacaatttattcccattgttgagccgctcgcgcaaaaagcgcagcgttctttgacgttatctgacaatgaagattcgccttcgctgatgcccttttccgtcacgcctgaagggtggggggcctttatgtgcgatgtttttgatcaatggatacgtcacgatgtcggacgcatattcgtacagctttttgataacttacttggcgtctggatgggggagcccgccacgctttgtacgatgcagtcgacctgcgggcaaagtttgctggtggagcagaatggcgacgtgtttagctgtgaccattttgtttttcccgcctataaactgggcaatctgcagcaacactctttagaagaaatggcggcctctccttttcagcagcagtttggcgcggctaaagcaaacctttcttcacgctgccagaactgtacgtggcgctttgcctgtcacggcggttgtccgaaacatcgaatttgtatggacggcggcgaacggcaaaattatctctgtaaaggatatctggagttctttcaacatgtgacgccctatatgaatgtgatgcgtcaattattactgaatcagcgacccgccgcgcatattacccgcatcgtcgacatgattgcggatgacgttcgtcagtgacaagaaaatcgccccccttgcgcggtatgatgccggacattaccgtagggtctaagagtcctgtattgttttaccgtcgagtgaaattgaaaaggaaatgaaatcagtgaaaaacgtaacgttttgcgggcaggtgacgcttcctgccatcggacagggaacatggtatatgggcgagcgcgcggatcaacgtcagcgcgaggtttcggcgctgcgcgcggggctggatttggggttacgccttattgatacggcggaaatgtatgccgacggcggggcggaaaaggtcgtgggcgaggcgttagcagggcgacgcgatgaggcatttctagtgtcaaaagtgtacccgtggaacgctggcggccagaagatagttgccgcctgtgaggaaagcctgcgtcgtctgaaaacagattatctcgatctctatctattgcactgggccggaggcttttcattcgaagagaccgttgaaggtatggagcggctaatcgcgcagggaaaaattcgccgttggggagtctctaatcttgattatgacgatatgcaggcgctgtggcgcatccctgggggacagcaatgcgcgacaaatcaggtgctctatcatctggcgtcacgcggtattgagtatgatttattgccgtggtgtcaacaacagcgaatgccagtgatggcctatagcccgctggcgcaggctggccggttacgtagcggtttactgaatcatccggtggtgaatgaaattgcgcaagcgcataacgcaacggcggcgcaaatcttactgacgtgggtgattgcgcatccgggcgtgatggcgatcccgaaagccggaagtacagaacacgtgaagcaaaatgcggcggcgcttgagattaccttgtcagcaaacgaacttgccttactggacaacgcctggcctgcgccaaaagggaaaaccgcgttggatatggtgtgacgccggataaaatgtgtaagtgccgccatccggcaggtcatgcctgatggcggctggcgccttccagagcctatagcaacgccgttatccattcacttttagcgtttagcgacgcagatagtctgcgccagacgagagggtttttcttctgtggcttgttgcggcgcagtagcgtaaaccgtttcaacgcagacaaacgttttatagccgtcatccggcatgtcgcccatgctgacggacaacgccgggccagggttccagcctacgacgttaaggtgatggtggtggaccacatcaatcgtgcggtttaatgtcgcatcgtggatcacgctacatgcttcaggattgaggtaaacgcgatcggtacggtccggaaaggtttgtataccgtcggctaggacatcttctttagcgtcgttaactttatcaataaaccgatcgccgagtccgctgaccttaacgttggcgatgtcgccaacgttaaaatagctgtggagcgcggatgtggttgcaaattcgccatgcgcttccagttcaatttcacaggttttacccactttaaaacgtgccagcagcgtgaaatcgtgcggccagtatttccgggtggcctcactgctttgcagctcaaatgtcagcattacgccattatcatcttcattatgcgcttttagcgcccacggaagattacgcgcaaagccgtgtgacggcagaccctgttgagccgcaggtccaaaccagggccagcagatcggtacgccgccgcgtagcgccacgccggttttgaaaggcgtattattactgagccacaatacctcttcctcgccaatgggtttctaggagagaaggtgcgcgccctgtaatgcaaaagaggctttaacctgcggatggtcaacgacgatcagatccaggtcatcaagctgacgacgggaaaggacaggggtaagctgttcgataaccgggagggcaaaaattttattaatcattacgcaatcctcttaaccctaaataattcgagttgcatgacaaggcgcttgtgccttgaccagtgcttgcgctggcccgtagaggcgaggccgcaggccgagtaacgcggcaagtgaacgacaaattcatcgggaacgaatttgaacaaccgtaggtaaccttcggtcaggggcatccctgattcatcccgataagttcgacttccgtcagtgattcgggtgagaaagcatagccaacacacctgcaacttgaagtatgacgggtatatctttaagcaaaaaaaagagcgacctgagtcgctcttaccaatgactgtgtcatctcaacttatttggagatgtgagcaatcaggtccagtactttgttggagtaaccggtttcgttatcgtaccaggagaccagtttcacgaagttgtcgttcagcgcgatgcctgctttagcatcgaacacggaagtgcatacttcgccgttgaaatcggtagatacaacgtcgtcttcggtgtaacccagaacgcctttcatttcgccttcggcagcagctttaacagcagctttgatctgctcgtaggtagccgctttttccagacgaacggtcaggtcaacaacggatacgttcggagtcggaacgcggaacgccataccagtcagtttgccattcagttccggcagtactttacctaccgctttagcagcgccagtagaggacgggatgatgttctgagatgcgccgcggccgccgcgccagtctttgtgagacgggccgtcaacggttttctgggttgcggtagtcgcgtgaacagtagtcatcagaccttcgatgatgccgaagttgtcgttgataactttagccagcggcgccaggcagtttgtggtgcaggaagcgttggaaacgatgtcctggccttcgtatttgtcaaagttagcgcctttaacaaacattggggtgttgtctttagacggacccgtcagaaccacttttttcgcgccagcggtgatgtgtttacgcgcggtttcgtcagtcaggaagataccggtagcttcagccactacgtcaacaccaacttcgtcccatttcaggttagccggatcgcgttcagcggtaacacggatttttttaccgttaacgatcagatgaccgtctttcacttcaacagtaccgtcgaaacggccgtgagtggagtcatatttcagcatgtatgccatgtactctgcgtctaacaggtcgttgattgcaacgatctcgatgtcagaacgtttctgagcagcacggaaaacaatgcgaccgatacggccaaaaccgttgatacctactttgatagtcatatattccaccagctatttgttagtgaataaaaggttgcctgtaaaattacaaaaaccttacgcagcgtcaagcggaatcgtgtcaatcattgcgacaaatcaatcctctgcacaacctttgcgcggctgattcgcctcactcttcctttcagcttgaaaccacatgggggcgccgccccgaattttaaagggcaaccgagataataatgtgacatcagtcacgattcgtgagccgccatttcgcaatgatcaagtttagaacaaaagttggtactgaggtgctaatgttttgttagaatcggtcaggcaatgtgagcacgtttaaagtgagatgtgagcaaatggctaaccaaccttcagcagaagaactcaagaaaaaattgtccgaaatgcaattctatgtgacgcaggatcgtggcacagaaccgccatttaccggacgcctgctacataataaacgcgatggggtttatcactgcctggtctgtgatacgccgctttttcactcccacaccaaatacgattcaggctgcggctggcctagcttttaccagcctgtcagcgaagaggcgattcgttacatagacgatttttctcatggcatgcagcgtgtcgaaattcgttgcggtaactgcgatgcgcatctcggacacgttttcccggacgggccgcagccaaccggtgagcgctattgcgttaactcggcctcgctggccttttctgacgagaaaaacggcgatcaactgaaaggctgaaaaaacgattcagcaaattattccacaggagcggacacatcatgaatcttgatgagatcattaacagcatgacgccggaagtgtatcaacgtttatccaccgccgttgagctgggtaaatggccggatggcgtggcgttgacgccggaacagaaagaaaacagcctgcaactggtgatgctatggcaggcgcggcacaataccgaagcgcaacatatgacgatcgatactcacggtcagatggtgatgaaaagcaagcagcagctcaaagcggatttcggtattacgtcaaagccgattgcgacattgaaaatgcagtaacggcagccggataagaggtagtcgccatccggtggtttaattgccaatgcgttgtgcttaccgggcctgctcattgctgtcaggcacaggcccgccatatttttacccattacgcttaatgtccagcgagtccgccaactgtttcgctaactgattattgtcattggcggcctattcccagaacattgcgccggccagcccgcgctttttaatctgtttcgttagaagcgctctccagcctgcgttgagctttgcctggtagcgacgctgacgtgacgtatccggcccaaagatctatgcaatggtctcaccgttgcgtgatgtattgaccggatacgatacctgctccgctacctggcgatagcctggccctgcgtctcttcccagtctgccagcgtatacagcgtcgcgcctgccgccgccatctccataaacgcgtgtgcgctatcctgcgggtgaatattcacgccgcgacagccatcggtgataacgttaacggcatagcccaactctagcgcatccagcaccgtaaattttacgcagtaatcggtcgccaaccccatcacgataagctcggtaacgtcatgctcgcgaagccaggtatcaagggtagttttctgccgatgttcgttgtcaaaaaacgcgctgtagctatcaatcagcgggttttcacctttatagatgcaggcgtcaatcgcatgttggttaagcaggggatgtaacgccgcgccgtcggtatgttgaacgcagtgatccggccagagcgtttgcggcagcccgtccagctttccctgtctatagggttccgcctgatgctggctggcgaagctgccatgctgcgcgggatgccagtcctggctggccagcaccggaatctgccggggctggcaccagtcaataagagcgttggcgatgtcgatggtgctgtcgccttccgctacagccagcgcgccgccggcacaaaagtcattttgcaagtcgaccagtaataaggcccggtttgtcattatcttctccttgtcgtcgggattttttaatcatccggcgtcaattcaccacgcaagttttgcgccatcgcgctacgaatcgcctgagtgtccagaccctggcttaacaaataatgcagtttggttaaggtagcttcgacggtcatatcggcaccgccaatcacgccagcgtgcgccagcgcattaccggtagcgtacccgcccatattgactcgccctgacatgcattgcgtcaggttaaccaccacgatgccgcgcgaactggcctctttcagctcctgtaaaaacgctttattttgcggcgcgttgcctacgccataagagcgcagaatcagcgcttttaccggctgacgcagaaagttacgtactacctcggcggaaatccccggataaatcgtcactacgcctatcggctgcggcgtaatagggtgaacgattaattcaccagaaccgtagggcgcgggaggcgtatttaaacggcgaatgtgaattcctgcttccagcaagggcggcagattaggagaggcaaaagcgtcaaaaccatccgcatgtgctttggtcgtgcgattgccgcggaacagacgattattaaaaaacagcgttacttcattaacagggtagttggcggcgacataaagcgcattcagcaaattaatttgcccgtcggagcgcagctcagccagcggaatttgtgaccctgtcacaataaccggtttacccagattttccagcatgaaagagagcgccgatgcggtatacgccatcgtgtcggtgccgtgcagaataacaaaaccgtcatactcatcgtagtgcgctttgatatctgcagcgatatgctgccagtcttccggcgtcatatctgatgaatccatcagcggggcatattcatggatggtaaaatccggcatctccgggcggtggaattccggcatcagcgccagctgacgctgaaggcgcccggacaccgggatataccctttatcggagcgctgcataccgatagtaccgccggtataggcaacgtaaattgatttcttttgcatgataatgttcagtcgtgtcgcgaaggacgtattaatgattatcggatggcggctatgagcagacgccgacatccggtatggctattgatgaagcattagcgcacgttcgcgcaagtcaaacagaacgcataacggttttgtggatcgttaaatgccgccagtttatccccctcggccttcaccgtgttggcggcggaaacgagcggcgccgggagcatcgcctgaatggcctccggcagcatggcgcgtacagatccggtcatactgtccatgaccatatcaaggactgtcggttcgtcctgatagtaatcaagatgccactgtttcagtttcgccagctccgccgctttggcgacggcgtcgtcaaagtcgccgagactgtccaccagaccattggctttcgcgtcttctccggtccagacatggccttgagcgattttgtcaatctgctccggcgtacgcttacgcgcgtctgccaccagcgtgataaagcgtttgtagccgtactcaatactgagttgcatcatctgctgcacttccggtgacagcgctttagtcatcgaaatatccgccagcggcgaggtggaaacgccgtcgctgtgtacgccaatcgacgacaggctgttttctaccgtattaattacgccgaagatgccaattgaacccgtcagcgtgctggggctggccacgatatagtttgccggcgtagagatccagtaaccgccggaggccgccatgccgcccattgagaccaccaccggtttgccagccgctcttgccgccgccagttcggcgcggataacttcggaggcgttgacgctaccgcctgggctattgacgcgcagcacaatcgctttcactttaggatcaaggcgtgcgtcgcggatctgcgatgccgtagtgtcgccgccgacattccctggcgtttcttcgccatccataatcgcgccattggcgaaaataaccgcaatagtaccgccggtatccgcaggcgttttcagcgaataatcgtaatagctgatcgcgcgatagttattttcggttttgctccagccaaactgcttcgtcagcgctttttcaacatctgcgctggaggcgagggcgtccaccagtttatggtcgagcgcatatttggcggtgtcaccgcccacgctggttaacccgtcgataatagcctgggcgccggggaagagttgttgcggcgaaatctggcgattggcggaaacggtatgcaggtagttctgccacagttcgcctatccagcggctgtcggcctcgcgggcggcgggcgacatatcgtcgcggataaacggctcgacggcggatttataggtgccgacccggaaaacgtgggtagagactttcagtttatccagcagcgttttgtagtacaggccattcgtagcgaagccgtgaagatctacctgaccctgtggggaaagccaaattttattggcgaaactggcgaggtaatactgaccctggctgtagttttcacccacggcgaaaaccggtttgccgctatcgcggaattcgcgcagcgctttaccgatatagcgcattgacggctgatcggcaccggtgaagtttttcagatccagaacgatacccgtgatgttacggtcatctttcgcctgacgaatagcgttgacgatgtcaaacagggagttttcctgcagacggtcggagctggcgccaaataactggcgtcccagcgcgcccagacggtgattggtggagggtttatccacaatgacgccggaaatatccagcagcaaagcgccgcgcgccgtttgctcactgttgctgccgttaccgatctgcatccagatcccaacgcccaccaggaccagaaaaataaagaacaggttgagtaccatttcacggacgaagttcaacactcgccacgtccatttaaaaaatccggcaataaatcgccacagggttcgcatgtattctccctatctgagtaacaacgcttataccttggtgaggataaagcattaagatgtggctatcgtaatgacccatcaggcagttgtcagcaggaatcactgcctgcgctgtaacaaaatccgctcccgtgttaattttgtgaataaatatcattgctggagttaatcaaatggatgcactagaactgctggtcaaccgtcgcagcgcctctcgtctcgcagaaccggcgcctgtcggagagcaattacagaacattctgcgggcgggaatgcgtgttcccgatcataaatctctacagccgtggcgtttttttgtgattgaaggagaggggcgcgaccgcttcagcgccgtgcttgaacaaggcgctgtcgctgccgggggggatgagaaagcgatcgaaaaagcgcgtaatgcgccgtttcgcgcgccgctgatcattaccgtggtggcgaaatgcgaagaaaaccataaggttcccgtgtgggaacaggagatgtctgccggatgcgcggtgatggcgatgcaaatggcagcgattgcgcaagggtttaatggtatctggcgtagcggcgcattaacggagagcgctatcgtgcgggaagcctttgagtgccgtcctcaggataaaattgttggttttctctatctcggcacgccgcagctcaaagcgtcaacgacgatcagtacccccgaccccacgccgtttgtgcgttatttctgacgctgagggataaaactgtctggattctgagcaaaggcgcggtaattcagacagtgatacttaccacatcagggaatgagcgctaccatagcgcgaatgcaatgacaggagatgtccatgagcaagcaagccattcgtttaacgcaatacagccacggcgctggttgcggttgtaaaatttcccctaaagtgctggagactatcctgcatagcgagcaggcgaagttcgtcgacccgaatctgctggtgggtaatgaaacccgcgatgatgcggcagtttacgatctgggtaatggcaccagtattatcagcaccactgacttctttatgccgatagtcgacaacccgtttgattttggccgcattgcggcaacaaacgccatcagcgatatttttgcgatgggcggcaaaccgattatggcgatcgcgatccttggctggccgattaataccctgtcgcccgatattgcgcgtgaagtgaccgagggggggcgttttgcctgccgtcaggccggtatcgcgctggcgggcggacactctattgacgccccggagccgatctttggtctcgcggtcacaggcgtagtgccgaccgaacgggtgaagaaaaacagtaccgcgcaggcgggatgcaaactctttctgaccaaaccgttggggattggcgtgttgaccaccgccgagaaaaaatcgctgcttaaacctgaacatcaggggctggcgacggaagtcatgtgtcggatgaacgttgctggcgcggcgtttgccaatatcgacggcgtaaaagccatgactgacgttaccggttttggtctgctgggacacctgagcgagatgtgccagggtgcaggcgtacaggcgatgctttgctatcaggacatccctaaactgccgggcgtggaagagtatattgctctgggcgccgtaccgggcggcacagagcgcaacttcgccagctatggtcatctgatgggcgacatgtcgcgtgaagttcgtagcctgctgtgcgatccgcaaacgtcaggcggtctgctgttggcggtaacgccggacgccgaagacgatgttaaagccaccgcggcggaatttggtatcgaactgaccgcgattggcgaactggtcgaggcccgcggcggtcgcgctatggttgagattcgttaacctgatgcggttgtttattgccgaaaaaccgagtctggggcgcgccattgcggatgtgctgccaaaaccgcaccgtaaaggcgatggttttattgagtgcggaaacgggcaggtcgtcacctggtgtattggtcatttgctggaacaggcgcagccggatgcgtatgacagccgttatgcgcgctggaatctggctgacctgcctatcgtgccggaaaaatggcagcttcagcctcgtccttccgtcaccaaacagctcaatgtgattaagcgctttttgcatcaagccggtgaaattattcacgccggcgacccggatcgcgaagggcagcttctggttgatgaagtgctggattatctccagcttcctgccgaaaagcgccagcaggtacggcgttgtctgataaacgaccttaacccgcaggcggtcgagcgtgctatcgacaggctgcgggcgaacagcgacttcgtgccgctgtgcgtctccgcgctggcgcgagcgcgagcggactggctgtatggcattaatatgacccgtgcttacacgatcctgggccgtaatgccggctatcagggcgtgttatccgtgggacgcgtgcagacgccggtactggggctggtggtgcggcgagacgaagagattgagaacttcgtcgccaaagacttctttgaagtgaaggcgcacatcgttacgcctgccgacgagcgttttaccgctatctggcagccgagcgaggcgtgcgaaccttatcaggatgaagaggggcgtttgcttcatcgtccgctggcggagcatgtggtgaaccgaatcaacggtcagcctgcgctggtaaccagttataatgataaacgggaatcagaatccgcgccgctgccgttttcgctctcgacgctacagattgaagccgctaaacgttttggcctgagcgcgcaaaacgtgcttgatatttgtcagaagctatatgaaacccacaaactgattacctatccgcgttccgactgccgttatctgccggaagaacactttgccggacggcaggcggtcatgaacgcgattagcgtccacgccccggatttactgccgcagcctgtggttaatcctgatacgcgcaatcgctgctgggatgacaaaaaagtggatgcgcaccacgcgattatcccgacggcgcgcagttcttctgtccatctgacggaaaacgaagcgaaagtgtacaccctgattgcgcgtcagtatctgatgcagttctgcccggacgcggtgtttcgtaaatgcgttattgaactggaaatcgccaaagggaaatttgtcgccaaagcgcgttttctggcggaggccggttggcggacgttactgggcagtaaagagcgcgacgaggaaaacgacggtacgccgctgtcggttgtcgccaaaggtgatgagttgctgtgtgaaaagggggaagtggtcgaacgccaaacccagccgccgcgtcatttcactgatgcgacattgctttccgcgatgaccggaattgcccgcttcgtgcaggataaagatctgaaaaagatcctgcgcgcgaccgatgggctggggacggaagccacgcgcgccgggattatcgaactgctgttcaaacgtagctttctgaccaaaaaagggcgctacattcattctaccgatgctggcaaagcgttaatacattcgctgccggagatggcggcccgtccagatatgaccgcgcactgggaatctgttttgacgcaaatcagcgaaaagcagtgccgttaccaggattttatgcaaccgctggtcggcacgttatatcagctgatcgatcaggctaagcgcacgccggtgaagcgtttcagagggatagtcgcgccaggcggcggagaaaagaaaaagagcgcgccgcgtaagcgagcgggcaaaaaaagcccgcctgctgaggagacaggccgtcagaccgaataagcgtaaagccatctggcctggcgacgggattaaatgacgccctgcgccagcatggcgtcggcgactttcacgaaaccggcgatgttggcgccctgaacgtagttagtatgcttattgtcgccgccgtacttgacacaggcgtggtggatatccagcataatatgatgcagacgggcgtccactttctcggctttccagctcaaccgcgcggcgttctgcgccatttccagccccgatgtcgccacgccgcccgcgttggcggctttacccggcgcaaacagtacgcccgcctcaaggaagagatcggtcgcttcaatcgtggttggcatatttgccccttccgccacggctttcacgccattggcaatcagtacgcgcgcggcgtcaacgtccagttcgttctgcgtcgcgcatggcagggcgatatccaccggtacgctccagggctgctggccttccagataggttaagccaaactcacgggcgtagtcagcgacgcgaccgtcacggctggctttaatttcacacagccgcgccagcttctctggcgtgaagccactttcatcgaccaccgtcccgctcgaatccgacgcggtaaccacgcgcgcgccaaaggccatcgctttctcaatggcgtattgcgctacgttgccggagccggacacggcgacgcgcatcccttcaaaaccgagaccatgacgtttaagcatcgcttcggtgaagtagaccaggccatagcccgtcgcctccggacgaatcaggctgccgccgaaggaaagccctttgccggtgaagacgcaggcgctgttattggaaagcttgcgcatcattcccgccataaagcccacttcgcgcccgcccacgccgatatccccggcaggcacgtcggtatccggccctaaatggcgatacagttcagtcatcagcgcctggcagaaacgcatcacttcgccttcgcttttccctttcggatcgaaatcgctgccgcctttaccgccgcccatcggcaacgtggtgagggcatttttaaaggtttgctcaaagccgaggaacttaaggatggaaaggtttaccgaaggatggaagcgcataccgcctttataggggccgatagcagagttgaactgcacgcgccaggcgcgatttacctgcacctgatttttatcgtccagccacactacgcgaaactggattacgcgctctggttcaaccaaacgttccagtaaagacatgtggcggtaacgggggttttgttcaagaaacggccacagggtggtcatgacttcacggacggcttgcgcgaactcggtttgatgcgggtcgcgcttttgtacatggttgaggaacgattccagagaacatgtctgatccatagatataaaaacctcttatatattaatgtggttgtatttgcgttttatcagaatatgtatttgcagttttcgactataccatcagcaatgtgacggtaagcaagaaaaaaatgacgctgctaagtaaattcataacggggagagggtcataactaaaagcgatgacaaaagaggattaaagttttcacggcggcttaccgttatactgagaatatacttggaaaaataaggaaatcctatgcgccgaagcctcatggtcgccgtgatggcgataatgccaatggtcgggctggcaaaccaaaacagtcgtcctgatattcaggtgaatgtcccgccggaagttttcagcacgcgcggtcagtcatcccagccctgcattcagtgctgcgtttaccaggatcagaattactccgaaggcgcggtaataaaagtggaaggcgtcgtgctccagtgccagcgtgacgaaaaaaccatcagcacaaatccgttagtctggcgtcgcgtaaagccataaacgcctgcaatagcggaatatccgccggggcgagggggtattccagcgcctcttccggcgtacaccaggctaaggcctgatgttccagcgcacgtatcagaccgttaaacgcaggcacatgccaggcgtgcaaatgaattcgtcggccagacacgtcgcgttgatggctggcgatatagacgccgggcgtggcgtcaatccctaactcttcgcgtagctcgcggataagcgcctgcggttgggtttcgccgggttcgactttaccgccggcaaactcccataaaccggcttgatccgcatgaactgggcgctgggccagcagtattttgccgtcgcgttcaatgatggcggcaacaacatcgagtttttttatcattgtcgttaaggtcgttattcctgccgggaagcgtcgcgctatcccggccttacggttaatcagatagcggaatcaaacacgaaacgtcgcccagaccggcgcatggtcggagggtttttccatactgcgaatgtcgtagtctataccggtttctgcgcaacgttccgccagcggagcgcttgccagcaagaggtcaatgcgcagtccgcgattatccacgaaaccttttgaacggtaatcaaaccacgaaaatttatccatcgtttgcggatttgcctgacggaacgtgtccactaatccccacttcagtaaccgcgacatccattcacgctcctccggcaggaaggagcatttaccggtacgcagccagcgtttgcggttctcttcgccgatgccaatatccaggtcggtcgggctgatattcatgtcgcccataattaataccggattatcgcacttgagttccgtttcaagatagttttgcaagttctgataaaactgcgctttcgcggggaacttcaacggatgatcccggctttccccctgcgggaaatagccgttaatgacggtgatattacccagcggcgaggggatttccgccatgataatgcggcgttgcgcctcttcgccatcatccggaaaaccgcgtctgacggaaatgggcgtggcttttgttagcagcgcgacgccgtaatggcctttttgtccatgatagaaaacgttatagcccagcttcgcgacctcttcgagcgggaacatttcgtcgtggacttttgtctcctgtagaccgatcacatcgggctggtgtttttcgacaatcgcttcaagttgatggggacgggcgcgcaggccgttgatattaaaagagacaaatttcatagtcactgccactttgcaaggtgaatcgtgttgggatggtagcagaaattttaccgggtgactgccactcatcgtcagattcggccaatggaagcgtatggtgttttctatagcgcgaaaatggcacggtttgcgtgcagatgcgccagaacggggcggtaatttccagtaaatttcgtataagatcacaattccagaattatatttggcaactgaataatatttcgctttttcctctttctagccaccgattatgcggaaatattcacttttcatgcagtaaaagtgaatatcgctacgctgtaacccattgatttaccgtttatcacttctgtttatgcaatgttaacgctggctggcacgaatgctgcaatctacatttacagcgcaaacacccatattaattaacatatagataactttatttttaccaaaagaggtcgctatgtctctgtcagttacgcgcgaaaactttgatgaatggatggtgccggtatatgttcccgcgccttttattcctgtacgcggagaaggctcacgcctgtgggatcagcaggggaaagagtacattgattttgctggcgggattgcggtcaacgcattgggacatgcgcatccggcgctgcgcgaggcgttaaatgaacaggcgaatcgcttctggcataccgggaacggttacaccaatgaaccggcgctgcgactggcgaaaaaactgatcgacgcgaccttcgccgaacgcgttttcttttgtaattcaggcgctgaagcaaatgaagctgcattaaaactggcgcgcaaatatgcccacgatcgtgttggcaaccataaaagcggcattgtggcctttaaaaacgcgttccatggccgcacgctctttaccgtcagcgctggcggtcaacccacctattcacaggactttgcgccgctgccgccggatattcgtcatgcagcctataacgatctgaactccgccagcgcgctcattgatgacaatacctgcgccgtaatcgtagagcctgtgcagggcgagggcggcgtgatccccgccacgaacgcttttttgcaggggctgcgtgaattgtgcgaccggcatcaggcgttactgatttttgatgaggtgcagacgggcgtcggacgtaccggcgaactgtatgcatatatgcattatggcgttacgcccgatatcctgacgaccgctaaagcgttgggcggcggcttcccgatcggcgcgatgctgactacgcaagactatgccagcgtcatgacgccaggtacgcatggcaccacctacggcggtaatccgctggcgacggcagttgccggaaaagtactggatatcatcaatacgccggagatgcaaaacggcgtcagacagcgccacgatgcgtttattgaacgtctaaataccattaatgtacgttttggcatgttcagtgaaattcgcgggctggggctactgcttggctgtgtgctacagacggagtttgccggaaaagccaaactcatcgcccaggaagcggcaaaagcaggcgtgatggtgctcatcgccggtggcgacgtggtgcgttttgcgccagcgttaaatgtgagcgacgaggagatagctaccgggcttgatcgttttgccctggcgtgcgaacgccttcaggcgggaggcgcatcatgcgggtgattcgtcctgtcgaacatgcggatatcgccgcgctgatgcagcttgcaggcaaaacgggcggcggcttaacctcgctactggcaaatgaagcgacgctggcggcccgcattgaacgcgcgctaaaaacctggtccggcgagctgccaaaaggcgaacaaggatatgtatttgttctcgaggacagtgaaacgggtgaggtcggcgggatctgcgccattgaggtcgcggtcggccttaacgacccttggtataactatcgtgtcggtacgctggttcatgcttccaaagagctgaatgtatataacgcgttgccaacattattcctgagtaatgatcataccggcagcagtgagctttgcacgctgtttctcgatcccgaatggcgtaaagagggtaacggctacttgttgtcaaaatcgcgctttatgtttatggccgcgtttcgcgataaattcaatgagaaagtggtggcggaaatgcgcggtgtcattgacgagcatggttattctcccttctggcaaagtctcggcaaacgcttttttctatggatttcagccgggcggattttttatgcggtaccgggcaaaaagcgtttatcgccgagctgatgcccaaacatcctatttatacccacttcttatctgaagaggcacaggccgtgattggcgaagtccacccgcaaacggcgccagcccgcgtggtgctggaaaaggaaggctttcgctatcgccactatatcgacatcttcgacggtgggccgacgctggagtgtgatattgaccgcgtgcgggctattcgtaaaagccgactggtggaagtcgcggaagggcaacccgcgcttggcgactatcctgcatgtctggtcgccaatgaaaactatcaccactttcgggccgcgctggtgcgtgccgatccgcagacttcacgacttgtacttaccgccgcgcagttggatgcgctgaaatgtcgcgcgggcgaccacgttcggctggtacgcctttgcgctgaggagaaaaccgtatgacgctatggataaacggcgactggataaccggtcagggcgaacgccgccgcaaaacgaatccggtgagcgaggagatactttggcaggggaatgacgctgatgcggcacaggtcgccgaggcctgtcaggcggcgcgcgcggcgtttcctcgctgggccagacagccttttgcggcacggcaggctatcgtagagaaattttccgtcctgctggaggcgcataaagccgatctcacggaggtcatcgcgcgtgaaaccggtaaaccgcgctgggaggcggcgacggaagtgacggcgatgatcaataagattgccatctcgattaaggcttaccatgccagaaccggcgaacaaaaaagcgaacttgtcgatggtgccgcgacgctgcgccatcgtcctcacggtgtgctggcggtattcggcccttataactttcccggccatttaccgaatggccatattgtgcccgcgttgctggcaggcaatacgctgatcttcaaacctagcgagctaacgccatggaccggggaaacggtaataaaactctgggaacgggcggggttaccggcaggcgttcttaatctggtgcagggcggccgggagaccggacaagcgctgagttcgctcgacgatctcgacggactgctgtttaccggcagcgccagtaccggatatcagcttcatcgtcagctatccggccagccggaaaaaatcctggctcttgaaatgggcggaaacaacccgctcattattgaggatgcgacaaatatggatgcggcggtacatctgacgctgcaatcggcgtttattaccgccggacagcgctgtacttgcgcgcgacgccttctggtaaaacagggcgcgcagggagatgcatttctggcgcggctagttgacgtcgccggacgtctgcagcccggcagatgggacgacgacccgcagccgtttatcggcggactgatttcagcgcaggcggcacagcatgtgatggaggcctggcgtcaacgagaggcattaggcggtcgcacgctactggcgccgcggaaggtcaaagagggaacctctctgctgacgcctggcatcattgagctgacgggcgtcgcggatgtgccggatgaagaggtgtttggtccgctgctgaacgtctggcgttatgcgcatttcgatgaggcgattcgtctggcgaataatacccgttttggtctgtcgtgtgggctggtgtcgacggatcgcgcgcagttcgaacaactcttgctggaggcgcgggcagggatcgttaactgaaataaaccgctcaccggggcagcgagtactgcgccgtttggtggtgtcggcgcgtctggcaaccatcggcccagcgcctggtatgccgccgattattgcgcctggccgatggccagtctggaatctcccgaactgacgttgcctgcgacattaagccctggcctcgacttttctcgcagggaggcggtatgacggcgcatgaagttaattttgacgggctggtggggcttacgcaccattatgccgggctatccttcggcaatgaggcatcgacccgccaccgttttcaggtgtcgaatcctcgtctggcggtaaagcaggggctgctaaagatgaaagctctggcggatgccggctttccccaggcggtgatcccgccgcatgagcggccctttattccggcgttacgtcagctcggcttcacgggtagcgatgagcagattctggataaggttgcgcgtcaggcgccacgctggctttccagcgtgagttccgcgtcgccaatgtgggttgcgaatgcggcgacggtttgcccatcggcagacgcgctggacgggaaagttcacctgacggtggcgaatttaaacaataaatttcatcgcgctcttgaggcgcctgttaccgaagcgctgctacgcgccatatttcgcgatgaaagtcagttttcagtgcatagcgcgttaccgcaggtcgcattattgggagatgaaggcgcggcgaatcataaccgtcttggcggcgagtatggttcggcaggcgtgcagctttttgtctatgggcgcgaagaggagaatgaaatacgacccgctcgttatccggcgcgccagagccgcgaagccagcgaggccgtggcgcgtcttaatcaggtgaatccgcaacaggttatcttcgctcagcaaaacccggaggtcatcgatcaaggcgtattccataatgatgtcatcgccgtttcgaatcgacaggtattgttttgtcacgaagcggcgtttgcccggcagaaagtgctcattaatcagttgcgtacgcgcgttgacggttttatggcgatagaggtgcccgccggagaggtttctgtatcagatgctgtggccacctacctgtttaatagtcagttgttaagccgtgacgacggctcaatgctgttagtgttgccgcgggaatgtcaggaccatgccggcgtctggcgctatctgaataagctggtggcggaggataaccccatcagcgcgatgcaggtgtttgatttgcgagaaagtatggccaacggcggcggcccggcctgtctgcgattacgcgtggtgttaacagaagaagaacgacgggcggtgaatccagcggtaatgatgaatgacgctctgtttacggcccttaacgcgtgggcggatcgttattatcgcgatcgcctgaccgctgccgatctggccgatccgttattattgcgagaaggccgggaggcgctggatgtgttaacgcgtctgctggatttggggtcggtttatcctttccagcaaacgggggcggctgatggataactttctggcgttgacgctaagcggcacgacaccacgggtgacgcaggggaagggcgcgggttttcgctggcgctggttaggccatggtctgcttgaactcacgcccgatgcgccggtcgaccgcgcgttaattctttctgcggggatacacggtaatgaaaccgcgccggtcgagatgctggataagctgctgtcggcgctgtattcaggcagcttgacgttaacgtggcgagtgctggtggtactcggcaatccgcaggcgctggcggcgggaatacgctattgtcacagtgatatgaaccgtatgtttggcgggcgttggcagtcctttgccgaaagcgatgaaacgcggcgggcgcgtgagctggagctaagtctggagaccttcttttcatctggccaggcgcgggtacgctggcatctggatctgcataccgccattcgtggctcgcatcatttgcgttttggcgtattgccgcagcgcgaccgcccgtgggaggcggattttctggcgtggctgggcgcggcaggactggaggcgttggtatttcatcaggcgcccggcggtacgtttacgcactttagctctgaacatttcggcgcgctttcctgtacgctggagttgggaaaggcgttgccgtttgggcaaaacgatctgacgcagttcagcgtaacctcgcaggcgttgtcggcgttgctgagcggtgtcgaaacgtcaacctcgttttcgccgccgctacgctatcgggtggtgtcgcaaatcacgcgtcacagcgacaagttcgcgctttatatggatgcgcaaacgctgaattttactgcctttgcgaagggaacgttgctggccgaggagggggataagcgcgtgacggtgacgcatgacgttgaatatgttctctttcctaattcctctgtcgcctgcggattgcgggctggattaatgctggaaagactgccctgataaatgtccctgtaagctcacgttaggattacagggatgatttgggacacagtttcatgctattacggattattcctagagaattgctttattaataagcgttgctgcgttatagttctgcataatttctgctatatcatgctgttgtatatttctctttcaactctgcgcaatttattctttttttcttcacaattggcgaaaaagtgttttttatactttcattgttttaccgttgttctgactaattgacgctaagacggttaaagttaatcacgacaacacggcgctgttttaaatatgccgtaaaaataactgaaaggaaggatggaaatatgcgtaaactgactgctctatttgttgcctctaccctggcgatgggtgctgcgaatctggctcatgccgctgagactaccaccgccgcgccagcggatgcgaagccaatgatgcagcataaaggtaaatttggcccacatcacgatatgatgtttaaaaacctgaacctgacagacgcgcagaagcaacaaattcgcgacattataaaagcgcagcgcgagcaaatggaacgtccgctgctggaagagcgtcgcgccatgcatgatattattgccagcgataccttcgataaagccaaagccgaagcgcaaattacgaaaatggaagcacagcgcaaggccaatatgctggcgcatatggaaacccagaataaaatttataacgttctgacgccggagcagaaaaagcaatataacgctaattttgagaagcgtctgacagaacgcccggcgcaagaaggtaaaatgcctgctgcggcagaataactttccgcataatttaagaccgccggtcttgtcgacaacacaatcgttgaggtggacaggatcggcggttttctttatgactggcgacagtcggtgtgcagttcaatgatctcatattgacctgacattagtggcttacagagaattttatagccatcctgatcaaagcccgcaggggtgcgcaccagggtggcggcctcatccagcgagggtaccgcccccagccataaccagttgttgataatgtggaactgggtcatttgtgggcggctctcttttaacgcgatagcgcctttccagggccagcaaaccacacgtaaccgttccagtgaggcctgcagacgaagaaaatgcgcctgcggggtttcttgcccacaacacgcgccagcgcagcgcttcagcgcgaaacgaaaacaggcgcgcccacggcttaccggttcaagccccagcaggccataacacaatttttgttcatcggcgaggttctgtaagctttgcagcgctgcccgacggttggcgaagagtccaaacaggttcggctcatgggaaaaatcgacgctgcgggcggaaacgacctcaatcttttgttcgctcaactgtagagagcaaagctggcgattacgacgtaaccgcttgttaaacagcggctgttgttctttgatcagtcgcgcctccagcagcaacgcgcccatttccccagcggtgcagatccagcttatccgccgcgcctgtcgcagcatagcggcctcgtcaggcgttcgcagatgtgagagcacccggctgcgaatatttacgcttttaccgatataaagcggcagcgtatcgctttcgctatgaaatatatagacgcccggtaaggctggcgcttcgctgaggaaaggacgtaaatgttctggatattcgtaaatggccgctgcttcaaactcaaggcggggggctgattgacgccgtaccacagtgatctccgttaactggttattcatccagtataacagcggatgggtgattaaaaaagaggctgggaagagaggaggccggatagacgagcgatatccggcacaacagtagaagtacgcttactttttccaaaagtcgtcgaataccgtaatcggtaaacggcgcttatgttcagtttttacgtaccagccttcgatagttttagcgatggcggagtccagcgttttgccttccaggtaatcgtcaatattgtcatacgttacgcccagcgcggcttcatcaggcagtgaagggcggtcgtcttccaaatcggcggtggggacttttttatacagatgctcaggacagcccagcgctgcgagaagctgtttgccctggcgtttgttaaggcgatgaagcgggttaatatcggtaccgccatcgccatatttggtgaagaacccggttatcgcttccgccgcatggtcggtgcccaccacgacgccgtgagtcataccggcgatgctatattgcgctttcattcgctcacgcgctttttcattgccgcgaacaaaatcgctcagctcaattcccgcttcgcgcagcgcctgttcgctggcgaggacggcgcctttaatattgacggtgagtactctgtccggctgaataaaagcaatggcgtcctggcaatcctgttcatcggcctgcacgccataaggcagacgaacggcgataaactgcagcgcattatcaccggtctcttcccgcaattcggtgatagccatctggctgagtttcccggccagcgtcgaatcctgcccgccgctgatgcctaacaccagcgatttcaaaaagggataggttttcaggtacgctttaagaaaatccacgctgcggcgaatttcttcttcagggttgatatgcggtttcgcgccaagcgcctggattatctcttgctgcagagtcatttaacccccttcgacattaaaaaatgaatctttaccctgttaaagctaacccttcgccgctgaaacgacaaggtttggcgggctaagcggtgtttaaaacaacatatcgctgcgttagagaattttccgaaagactttttgtcgcgaggcgcggcttgaaaaatgttctgatgtattccaggcttacataacacgctgataaacaagaggacggaaaatgaacaagaacgtagcaggaattttaagcgcagcggcggtaatgactatgctggcaggctgtacggcgtatgatcgtacaaaagaccaatttgttgagcctgtcgttaaagatgttaaaaaaggaatgagcagggcgcaagttgcgcagattgcgggcaaaccgtcatctgaagtgagcatgattcatgcgcgtggtacctgtcagacctacatcctgggtcaacgtgatggtaaagcggaaacctactttgttgcgctggatgataccgggcacgtgattaactccggctaccagacctgtgcggagtacgacactgacccacaggcgccgaagcagtaacaactgtacattgcctgaacattcaaggaaaccggcctgcgagccggtttttttgtgcctgccataaccttatttattatcgcgaattatttgcccgaaatgtgaggggggtcataacgccaggtcaatgagagacaatttagtaggtcaaggaaataccatccggcggtccgatcccgtatactcatttcagccacctaaaaaagtaaatccggttacgcaagtcgcccagagtatggatgcaggttgaggcttgcggcgtatctggttgacagataatcgcacatgaggaaggtttttatggaaaagaaacacatttatctgttttgttctgcgggcatgtcaacatcgttactggtatcaaaaatgcgcgctcaggctgaaaaatatgaagtgccggtgattattgaagcattccctgaaaccctggccggtgaaaaaggcccggcagcggacgtcgtgttattaggcccgcaaattgcttatatgctccccgaaattcagcgtttattacccggtaaaccggtagaagtcattgattcaatgttgtacggcaaggtagatggcttaggcgtgcttaaagctgcggtagcggcaattaaaaaagccgccgcgaattaattattttttaatttttcccgtcaaagagttatttcatacactaaccgcaatattttattgcggtatttaagggtatttttctatgagtaacgttattgcttcacttgaaaaggtactccttccttttgctgtaaaaataggaaagcagccacacgttaatgcaatcaagaacggctttattcgtttaatgccattaacccttgcgggggcgatgtttgtattaattaataacgttttcctgagctttggggagggggcgtttttttattccatgggcattcggcttgatgcctcaaccattgaaacacttaatggattgaaaggcatcggcgggaacgtctataacggcacattgggcattatgtcgctcatggcgccattttttatcggcatggcgctggcggaagagcgcaaggttgatgcgctggccgccggactgctctccgtggcggcatttatgaccgtaacgccgtatagtgtcggcgaggcctatgccgtaggcgctaactggctgggcggcgcgaatattatctccggtattattattggcctggtggtcgcggagatgtttacatttattgtccggcgcaactgggtgattaaactaccggacagcgtaccggcttcggtgtctcgttcattctcagcattaattcccggctttattattctctctattatggggattattgcctgggcgctgtctaattacggttctaacttccatcagattattatggacactatctctacgccgctggcatcgctgggtagcgtggtagggtgggcatatgtcatttttgtaccgctgctgtggttctttggtattcatggttcgctggcgctgaccgcgctggacagcggcatcatgacgccctgggcgctggaaaacatctctatttaccagcagtatggctccgtcgatgcggcgctggaagccggtaaaacgttccatatctgggcgaaaccgatgctggattcttatatcttcctcggtggtagcggcgcaacgctgggtctgatcatcgctatcttcctggcatcccgtcgcgcggactatcgccaggtggcaaaactggcgctgccgtcaggtatcttccagattaacgaacccatcctgtttggcctgccgattattatgaacccggtgatgtttatccccttcattctggttcagccgattctggcggcgattacgctggtggcttactatttgggtattattccgccgattaccaatattgcgccgtggaccatgccaaccgggctgggggcgttctttaacaccaacggcagtgtcgccgcgttgctggttgcgctatttaacctggcggtcgctaccctgatttatctccccttcgtggtggtggctaacaaagcgcagaacgccatcgagcaggaagaaagcgaagaagatatcgctaacgcactgaaattctaaactccgcgtcggcatgggatgccatgccgggctgaatcagaggaaagactatgtttgatcttgaaaatgttgtagataaccagacagcggctgaggaactcgaagaagtcgttatggggcttatcatcaattctggtcaggcgcgcagcctggcatatggcgcgctcagaaaagcgaaagaaggcgactttgaggcggcgaaagcgatgatggaccagtcgcgcatagcgctcaatgaagcgcatcttgtgcagacaaaactcatcgaaggcgatcagggcgaaggcaaaatgaaagtcagtctggtcctggttcacgctcaggatcatttgatggcctcaatgctggctcgtgaactgatcgctgagttgattgagctccatgagaaactgaaataacagggggcggatgatgcagctacaggttaacgcaacggaaatcaaaacggtttatgagcagcagctcttcaatggcaaaaatttccatgtgtttatctataacaagacggaaagcgtcaccgggctgcatcagcacgactattatgaatttaccctggtattaaccggacgttattaccaggagattaacgggaagcgtgtgctgctggaacgtggagattttgtttttatcccggtggggtcgaatcaccaaagtttctatgagtttggcgcaacgcgtattctgaacgtaggaattagtaaacgtttttttgaacagcattatcttccgttactgccgttttgttttgtggcatcgcaggtatacagggcgaatagcaccttccttacctatattgaaacggtgattgcgtcgttgaattttcgcggcaatgggctcgacgaatttatcgaagtggtgacattttatattataaaccgcttacgtcattaccgcgaagagcaggtttatgatgatattccacaatggctgaaagcaaccgtggagataatgcatgataaaacgcagtttggcgaacatgcgctggaaaatatggtgcgcctgtcggcaaaatcccaggagtatctgacgcgcgccacccgacgttattacagcaaaacgccgatgcaaatcattaatgagattcgcattaattttgccaagaaacagttggaaatgaccaactattcggttacggatattgcttatgaagccgggtacagtagtccaagtctgtttattaaaacgtttaagaagatgacctcattcacgccgaatagttatcggaagcgattgacggaaattaatgagtaacggtttacattgctcgattagttacatttcacgcttgccccaatagcgcggggaacgtcacgctatttcttacgagcgggcatagcgtaatacatatcagtgtcatacactgaagggagatattatgagccagaaattaaaagtcgtcactattggtggcgggagcagctacacccctgaattacttgaaggctttattaagcgctaccatgaattacctgtcaccgaattatggctggttgacgttgaagacgggaaaaagaagctgggcattatttatgatctctgccagcgaatgattgataaagcaggcgttccgctaaaattgtataaaacgctggatcgccgggaagcgctgaaaggcgctaattttgtcactacccagctacgcgttggtcaactcaaagcccgtgagctggacgagcgtatcccgcttagccacggctatctggggcaagaaaccaacggcgctggcggtttatttaaagggttgcgtaccattccggttatttttgacatcattaaggatgttgaagaattatgtccgaatgcgtgggtcattaactttactaacccggcggggatggtgacggaagcggtttatcgtcataccaactttaaaaaattcatcggcgtatgtaatattcctgtcgacatgaaaatgtttattcatgacgtgctggcgctgaatgagaatgacgatctttccattgacctgtttggtctaaaccatatggtctttattaaagatgtgctggtgaatggcacctcacggttcgcagaattactggatggcgtggcgtccggtcagttgaaagcgtcaaccgtaaaaaatatctttgatctgccgtttagtgaaggattgattcgctcgctgaacatgctgccgtgctcttatttgttgtattacttcaagcaaaaagagatgctggcgattgaaatgggcgaatattacaaaggcggcgcgcgcgctcaggtcgtacaaaaagtggagaaacaactcttcgacttgtacaaaaatcctgagctaaacgtgaagccgaaagagcttgagcaacgcggcggcgcttattattccgatgccgcttgtgaagtcattaacgctatttataatgacaagcagactgagcattatgttaatattccacatcatgggcatgtcgagaatatcccggcggactgggcggtggaaatgacctgcattctgggacgcaatggcgcgacgccgcacccgcgtatcacccgttttgacgaaaaagtgctggggcttatccacactattaaaggatttgaggtcgcggccagcaatgcggcgctgagcggaaactttaatgatgtgctgctggcgcttaacctgagtccgctggtgcattccgaccgagacgcagaagtcctggcgcgtgagctcattctggcgcatgaaaaatggctgcctaattttgccgcttgcatcgaagcgcttaaaggtaagcaccactgacagaggtaggctatggaacgcgtgttgattgtgaatgccgatgattttggcctgagtaaagggcaaaattacggcattgttgaagcatatcgcaacggcgttgtgacctccacgacggcgctggtcaatggcgaggctattgaccatgcggcgcagcttagccgcgagctgcctgcgcttggggtgggaatgcattttgttttgacgttaggcaaaccggtgtcagagatgccgggcctgacgcgagacggcctgttggggaaatggatctggcaaatggcggaggaggatacgcttccgctggatgaaattgcgcatgaactggcgtgtcagtatcagcgtttcatcgacgtatttggccgcgagccaacgcatctcgacagtcatcatcatgtgcatatgttcccgcaaattttccccatcgtcgcccgctttgcggcgcagcgcgggattgcgttacgtattgaccgccagacggtgttgaatgcagacgatctgccgtcggatttgcgcagcactcaaggatttagtagtgaattttacggcgaggagatcaccgaagcgtgctttttacgcattctggatgcctcggcgcatcgaggagaagcctctctggaggtgatgtgtcatccggcgtttgtggacaacattattcgccagagcgcctattgttacccccgcttaactgaactggaggtgttgacgtctgcgtcactcaaggcagggattgcggaacgtgtatatcgtcctggcagttttcttgatatttagctcctgagtttgcggcgcaagaatgcgccgcattttttgtctatggaaaacccccagctaggctgggggttccggaaagctttcagctttaagccagttattaaaaccccttttgatttgttaaaacatcttgcggtctggcgactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattttgccgtttatgcaggaatcgcgttaattttccccgcacgcgaccagacacggtgtgccgccatcagcgtcagcagagtgtccataaagtggtggtcaacgttatctgcctcaacaagtccttcttccccctggctatcaatgtttaaaagcgccttaaaccgtcgggcgtcgcctgccagtgcgatgggcttcagatgtttgtaggcttccagaaggtagtaacgggcatcgccgcaactctcgatatcggcaatattgccgcacggtactattaccgcatcgaccgttagcgacggcgcgccggcaaaggttgccgcaatagttaatgttgaaccgtcatcagccgttacttcccccatccgtgaatagagcagttttacgtggacgcctttggcttttaaagcctgaaaaatggtcaacagttcggcggcgttaaccttgtcgttcagcagaatagcgaccactcggcctttaacatcgccgtccggcaccgcatacaggctgagcgccggatcttttttcagaccgttgacatcaggaggcggggcaatttgcgtttgctcatgggtgagtgcaaaaccgagattatgcgcgacgccctgagccagcgtgacatcaatatgcgctaactgatcgaccacccgctcccgaatatacgcgcgggcgactttacccagctcaaagctgaacgcgtcaataatatgctgctgttctatcggcgtctgactgagccagaacaggcgaggatgcgagtaatattcaccgaaagaggggctgcgttcgcggatttcattaccatccacgcgttcctggtatgattcgaagccgccgcgttttggcgctggcggcgtttcgcgtggccagttgtcattaatggagtttggttcatagttcgccggattggtgtcgatatccatccggtgcataccgtcacgctggaagttatggtaggggcaggtagggcggttaatcggaatttcgtggaagtttggcccgcccagacgactgatttgcgtgtcggtataagagaacagacgcccctgtaacagcggatcgttggtaaaatcaatgccgggaacaatatgtcctggatgaaatgccgcctgttcgttttcagcgaaaaagttatccggattacggtttaacaccattttgccgacgcgttgtactggcaccaactcttccggaatcagtttggtcggatcgagcagatcaaaatcgaatttaaattcatcctcttcggcaatgagttgtaggcccagctcgtattccgggaaatcgcccgcttcgatggcctcccacagatcccggcggtgaaaatccggatcgcgaccggtcagtttttgtgactcatcccataccagcgaggctttacctgccaacggtttccagtggaaacggacaaaggtcgctttcccttgtgcattgatcagacggaaggtgtgaatgccgaacccttccatcgtccgataactccgtggaataccgcgatccgatattgcccacatgacgttgtgcagcgtctcaggctgtaaggaaacatagtcccagaaggtgtcgtgcgcgctctgcccttgcggaatagcccaatgtggttcgggcttaacggcgtgcacaaaatccggaaacttatgcgcatcctggataaaaaagatcggcgtgttattaccgacgagatcgaaaattccctcttcggtataaaatttggtcgcaaaaccgcggatatcacgtacggtatcagcagaccccgcgccgccctgtactgtcgaaaagcgaacaaagaccggggtaattttctgtggatcgcacagaaacgcggctttcgtgatgtcgctcaggtctttatatggctggaaatagccgtgcgctgcagatccgcgggcgtgaacgatcctctccgggatacgctcatggtcaaagtgggtaattttctcgcgcaggataaaatcttccaacagcgtagggccacggctgccggcgcgaagagaattttgatcgtcggcgatgcgcacgccctgattggtggtcagcgcataattttcgctgcctttacgaaaggcgtcgagggcggtgagcttatcattcgcggtctcgggcgcttttaagctgccgggggccgttggttgcgcgcccggcggcgtcggttctggcgtggggcgatgtgaaccgtctgacggtgccagggagtccaggccgggctgtgattcacgggtatcatgcacgggggactgatggggggatttttcattatgcgacattgaactcgtctcctgctttcatcactgaaatgggcgtggtagtagtcaaaatcactctaactatagaacatttcagcaattatgccgggggagagcggaacggcagacagggtacaacggggaaatcgcacgcgcggaacaggacgtcgggggcgaagatcggctaaaatagtgtttttctgatttttagccttagcctcttttagtgaagcattaatgatgaaacctcttcgccagcaaaatcgccagattattagctatattccgcgtgttgaacccgcgccgccggaacatgcgataaaaatggatacgtttcgcgacgtctggatactgcgcggtaaatatgttgcctttgttctgacgggggagtcatttcaacggtcgcccgcctttagcgtgccagaatcggcgcaacgttgggcgaatcaggttcgccaggaaaacgaaatcgctgactaagaaaaaaacaaaacgccggtactggagaccggcgtttttagtgacagacattttgagttgccgatcgtcgtgtctcagacgatgtgaactcccgataatgtattatcgatgcgccagttcagcgtcttcttcgctatcgagaatggttttatcggtctgcttcagccactggctggtcagcgtacccgcggtcattgagccgctcacgttcagtgcggtacggcccatatcaatcaacggttcgacggagattaacagcgcgaccagcgtgaccggtaagcccatggcaggcagcacaatcagcgcggcgaaggtcgcgccgccgccaacgccggcaacacccgccgaacttacggtaacgatacccaccagcgtggctatccatacggggtctaaggggttgatgccgaccgtcggcgcaaccattaccgctaacatcgcaggataaagaccggcacaaccgttttggccgatggtcgcgccaaaagaggcagcaaagctggcgatggactccggcacgcccagacggcgggtttgcgcttcgacattaagtggaatggaggcggcgctggagcggctggtaaaggcaaatgtcagcaccggccacaccttgcggaaatatttcagcgggctaatcccgttcacgcccaatagtatgccgtgaaccacaaacattatcgccagaccaagatatgacgctaccacgaagcttccaagcttaatgatgtcctgcaaattagagccggcaaccactttcgtcatcagcgccagtacgccgtaaggcgtaagttgcatcaccagacgcaccagcttcatcacccagctttgcagggtatcgatagcaacaagcacacgctcgccttttggcgcatcatctttcagcagtttaagcgcggccacgcccaggaatgcggcgaaaatcaccacgctgataatagacgtaggatttgcgccagtcagatccgcaaacggatttttcggtacaaaagacagcaccagttgcggcacgctgagatcggccactttgccgacatagctcgtctcaatggcattcagacgcgcggtttccgcgccgccctgaaccagaccttccgccgtcagtccgaacagattggtgaccagcacgcccaccagcgctgcgataaaggtagtaaacagcagcgtgccgatagtcagaaaactgattttccccaattgagaggcgttatgcagtcgtgccacggcgcttaaaatagaggcgaataccagcggcatcacaatcatttgtagcaattgcacataaccgttgccgacaatattgaaccactgaatggagtcttttaacacctgactgtcagcgccataaatggtgtgcagggccagaccaaagaccacgcccatcacaaggccgacaagcacttttttagccagactccactgtttatgacgggcctgcgccagtacaaacagcagaatgacgaacaccgcaatgttcgcaattaatggaaaattcatccccgttctcctgatttttttattatgaagcgctgtgttttagcgattctgttcgcgcaagattagcagaactgtgagctggctcttatattcaaatggaatggtttatacctaaaatgactttggcgttgatttactaatcaatctggtgatttataaaacgattgaactgcatttgcaggatagtgatcatctgcgaagaccagcgtatgacgttgttttccggcatggattgcggcatccacaccgcccaggcaaacaacgccatacataaaaatcgctccagttgattgcccttgcgcggcgccagaataggcaggcggaaacgccagcgacacggccacagtaagggaacgcctgcgggggtaagcatatccgcgacgatatggcttaaatagccgagtaccatgccttgcagcgcatccgccgggataatccacgtatccggaaccttgagataaaaggtcgccagtagggcaaagaccgccagcagactatgggtaaacccccggtgaccgaatgcgcgggcgatcggtttcgatacccatttcaggcgctgaccaagaaaagatttggggtgatcgatatccggcagcagacaggtcaaaatagccgaaggaataatatgccaccagtcgccgtgcgcaagggcgggcgttaactcggcattcttggcgaaaaccgcgctggctatagaaaaaagaagatgtccttccgccgtcatgataaaacccattaaactgtcaattcatacagtatagggtttttatacagtaggcggaagtggtgacgttgtaactctttgtctctgtcaaagccgcttgccgtctggctcagcggctaattgcccgttgactttgtttcggaaacatcttaaccgagtagatgcgccgccgtcagctctgtcagtgagttaagtttgacattcgccagcgcaaagcgcggatcatgctggttttcttctgctggcaccacaatggcgcgcattcgcgccgcctttgccgcgattaaaccattcaccgaatcctccagcgccacgcaggttaatggatcaacgcctaatttggccgcacaatccagatagacctgcgggtgcggtttgctgtagggcaatttttccgcagaggccagcgcgtcaaaactgtcgcgcagttcaaacatggtgagcactttttccagcatatgcagcggcgatgccgaggcaagccccactaatagcccctgcgctttacacagcgccacagcttcgcgcacacccggcaaaagagggcgcgtctcttcgataagcgtaatcgcgcgggcaataacacggtttgtcacttcctggcgatcggggccgttccacggttgctgcgcaaaccagagatcgacaaccatatcaatgcgtagcctaagcgtgtctggcagttcatggcgccgagtaatatctacgcctaaacttgccatcacgtccagttcagcgcgatcccagagcggttcggaatcgatcaatagtccatccatatcgaaaattgcagcaagaatttgacgtggggttgacatcacaacctctcctgttgagattaaaaaataacgaattaagcgttcattatgaccatgttcttagtatatcgcccttaaagatcaggcgaaaacgggaatcaacaggtagacttaggccaaaacgacgcgtctttatcaaggggaactcatgacgtatcaacaagctggacgcattgcaatcctaaaaagagttgttgggtgggttatttttattccggcactgctttccacgctcatctcagtccttaaatttatgtatgcgcacagtgaaaagcaggaggggataaatgcggtaatgctggattttacccacgtaatgatagacatgatgcgcgtgaatacgccgtttctgaatgttttttggtacaactcgccgacgccgaattttcagggaagcctgaatatcggtttctggctcatttttattctgatttttgtcgggctggcgatgcaggattccggcgccagaatgagccgccagtcacgttttttacgtgaaggcgtggaagatcagttgatcctggaaaaagcaaaaggcgcggaaggactaacgcgtgagcagatagagtcacgtatcgtggtgccgcaccataccatctttttacagtttttcccgctctatattttgccggtcattattatcgtgctcggctactttttcttttccttgttaggtttcatgtaaactgaaaaatgccggatagcccgtatccggtgtgggctgtacctataccgcaagcagccgatccatcgctttttgcgcagtagccaggtgctgaccgccaaacagccttgcccgattaagcagggtgtagagctggtaaatcggctgcctgtcgagaaaatccagcggtagcggcgaaacggactgatagccgtcataaatctgcggtggctgatcggtatgcagcggcagcatcgccagatcgcattctctgtcgccccaatagcaggctggatcgaagatataggggccgtcagggccaagcgcgcagttcgccgaccatagatcgccatgcaaaagagaaggctgcggttgatgcgacgccagacgttgctgaacatgttcaacaatggcgtcaatattaccaaaggtaatgcctttttccgcggcgagttcaagctgccagccaatgcgctgttcggcgaaaaaagtcgaccaacggcgttgccaggtattcggctgcggcgtggtagagagcgcgttatcaaaatcgaggccgaattgaggttggtcgctccattggtgcaggcgcgccagctgttgcccaagaataaacgcattatgggcatccagcgggcggggcgagaggtagtccatgactaaaaagctgtaatcccgatccgaacctaccgcccataccttaggcacaacaacggttttactgcgggagagcagctccagctgatcggcttcagcggtaaaaccgcgaagcatttctcgttcatcgcacttcacgaaaaaatcatggccggcataacgtaaatgccatgcggcatgaacttctccgcctggcagttcattacgcagttcgatttcgccttcaccgacttgctcgcttaaaagacgactgatagcttgccacataatgtctctccccacgttgtctgccagatcataaggttagcgcaaaaatgcggttaaaaaatacgaactaacgcacatcgcggacgcgccgcggcgggaatggcacttattgtgcgtttttactccacgcctcccaggtcgccacggtaatgtcgacatccttatctaacgcgcttttcgcaagtccggcgacaagcgctttgatttcatcagcgctctgagcgctaacaaagccaaacgtattggtgccgagctcatgcacattcccttcatcgtccgttaatgtcagcaaaaaaccgctgcgcgtcagatggttattgagttcgttaatctcggtcagggaatcttcatggaaggttacggtaataacataacgggtaatatcgccactggccatcgttcacctcgttgggagcaactgtgtttttaacagcggcggatgcgccgcccgttaaccgattttccggtatccccctcggcgagggggaaacgattattgcgcggaaagataggcgtatattttttgggtatcgtcatgagaacacagacgcgtaccttgattgagcgtagcggcgctgcctgccgccacaccgaagcgcaccatctcttccagcgacgcgtcttgcgccagttttaacgtcatcgcgcccaccatactgtcgcctgcgccgacagtactttgacttttcaccgggggaggaacaacctggatgcaattctcactgtctatgcccagcgccccttgcggccccagagagaccactacccggcgagccttgccactttgcactaattcctgggccgctttacgcacatcatcaggctgcgtcagatcgcgattgactaacgcgctcaattctttcaggttaggtttcaccagttcgatatcgccaagcgccaacgcagcggtgagcgcgtcgccagagctatcaataatgcagcgaatgccttgcttctgcgcggcggaaatcagttgcgtgagtttctcgaccttaacgccgggcggaaggctgccgctgataaccagaattgccccggattcaatttccagtacctgttcttcaagctggcgaaattcgtcatcgtccagcgtggcgccgggcataacaaaacgatattgttcgccgctggactcgacgtggacgtgcaggttctgacgcgtccagtccttcgcatcgacggtagacacggggacattttcgtcagccagtagtgcgaccagatgttcgccggtagcgccgccagccgggaaaattgcggtcgcggtgccgccaagatgcgcaatggcgcgagcgacattaatacccccgccgccgggttcgaataccggcgcggagcaccgcagtttaccttcgggataaatttgcggcgtgattgttgcgctatcgagagagggcgcaagcgtcaacgtatagatacgtaccatcgttacctcctgttaggctgatttcagtctggcacttaatccccggaaagtgaaggaattaacaatatgattttccggatctttatttaaagaagtacgatgtaaagttatataaataaatgaatgcttcgggagggttcttattcaaaaaatgaaatagtaattgattgctatgttattcggggcttcttataattcgctacctttccaggggcgtttgtcattgatccctatgaaagtttccgggaccgtcgtggtctcttttttagttgtacggactctatataaatgaagcttttgaaggcagtacccgctgtagttatgctggcgggtggcgtgttcgcgtctctgtatgccgccgccgatgattccgtttttactgtcatggatgatccctccaccgcgaaaaaaccttttgaaggtaatctgaatgcgggctaccttgctcagtcaggcaatactaaaagttcttccttaacggctgacacggcgatgacctggtatggacaacgtaccgcctggtcattatggggcaatgccagcaatacctcctctaatgatgaacgctcttcagaaaaatatgcggtaggcgtgcgtaaccgttttaatatgacggattatgattatacctttggccaggccagttggctgacagaccgtttcaacggttatcgtcagcgcgacgtactgaccgccggttacgggcggcagttccttaatggtccagtgcacagcttccgttttgaattcggtccaggggttcgctatgacgaacatacggacgataccactgaaacgcagccgttgggttatgcttccggcagctatgcctggcagttaactgacaatgctaagtttacacagggggtgtcagtatttggcgcagaagacaccacactaaattcggaaacagccctcaatgtcgccattaacgaacattttggtctaaaggtggggtataatttaacgtggaactcgcagccgcctgaatcagcgcctgaacataccgatcgccgcactacggtaacgctgggctataagatgtaatattgcgccgggttacgttacgtaacccggttattccgtggtgacgcctcagaagaagaaggtgatgtcgccgttgatataagaatagtcgtctccggtgcgaaattccgacgtgactttgtttaaagaaagagaaaatgcgacgggagaatagccgatggtggcaccgacgcgatattcatccacggttttattaatatccaccgtttccatttttgtttgcagcgttttcccctgtaacgtgtagtttttatcaacttccctgcgctcaacgccagcaaatactttatagatcaatccctctttttgagtgtgtattaaccctcggcgggacaataacccaaacccattatcagagttgaaggtcttatcatttcccagcgcaacggttgcgccgtaccccaaatactggaagagattgccgccgacagcagagacttctggatagaagcccacattgacacccagaatatcaatagctggcgtaagggagaccattccttttgccgtgtaaccataacggttttcaatttgatcctgccaggcagggtatttttctgcgcctattattcgatgcgcccgattctgaacctcctgaccgcctgcgtcaggaccaataacgccgatatcggtacctaaacgataacgtaaccaattggtggctaatgaattccactccagtccggtatgaagaaaggcgctgaacgcgcggtcgcctttgacggcttcaggctttcttttattggcgccagatggagaataaatatcttgcgcgatatgaaaagagagttgactggcgtcagtgagatcgtggctgtagcctaaaaagagcccggcagtataatcaccccggtctgcagccttgtgcccgtaaagggcatttaaggatggttgaaatatacctgcatcatcattcgccactgaaatagcaaggctactggcattggccattgtggtcgtactgagtatggcggcaatcatcgttgcgcaatagctgtatttgttcactttttacccctgaatatgaaagtgaatactcttatttttacaaagtaataagcacagcagcatgatgcgcagtgcttattaaacctttaaatataactaaactcctgccagcagcgagtcattgagaggatacgttgccttaatgttgaaaaatggtgttaaaaaacatgcgccagatattattgaatatccatttttcattcgctatctgagtgcgagaaattattggcttcacgattatgcatataatacgatgttttttggtatcaacatgaatatcatgttgtattcttttgagctcattttctttgatggcttcgatgtttatctgttattaatttttaccgtgatagtgttgtctttaatgatgagcgcatctaacggctggcagggtaatataaccaaattattgccatctgaattattagggcagttattattaaggaagaaaaaatgaataaaaccattaatctgctaaaattactgcccgtagtattattaagcgcatgtactacatcgtatcctccccaggatacaacatcggcacccgagttaccccatcgtaacgtactcgttcagcaacctgataactgtagcgttggctgtcctcaaggaggaagtcaacaaacaatctatcgccatgtctatacgctcaataataatagcgccacgaaatttgccaactgggttgcctatagcgtgacaaagaccagccaggcaagcggtcgcccgcggaactgggcgcaggaccccgatttaccgccctcggatacgttggccccttcggcctataaaaatgcccatacgctattaaaagtcgacaggggacaccaggcgccgttggcaggattgggcggcgtttcggactggccgtcgttaaattatttatcgaatattacgccgcagaaatccgccctgaaccagggagcatgggctgcactggaaaaccgggtgcgcgaacttgccaaacaggctgatgtatctgtagtgcacgtagtgaccggcccccctttttgagcggcatatcgccacattgccagaagatgcgacggtagaaattcccagcgggtactagaaggttttattcaccggaacggcgccgtcaaaaagtgaaggaaattacgctgcgtttattatggatcagaatacaccccgttcggcgaatttttgcgactatcaggttaccgtggaggctatcgaacataaaacgaagccagtgctgacgctgtggtctaacttgcctgaagcggtagccagcgaggtgaaaacaacaaaggggagtctggcgcagaggttaggttgccgatgagaagcgctatacggcgcgtagaaagataatggagaaaccctgtcaaggggcttgatttgctacagagtgatgcaatccccctttttttagtgttaccatcatcatgccggacgaaaatagcgattttcgtctgtgtcgaaggttgtgcgccaatttagcaatggttggctagatggatacacaactcactgttaataaattcattttctctttgtatgtgatcttgcgtaataagtacaatcctttattcacatccattctcgttcgtttaaacctgtttcaccagttccgcgtcattactggtaatagcggatatatatgtttcataccgttttacattgatccctttcgcgccgtaagatgtacgtacctaatctaacttaagcagggaactgtcattcataacacagagtttattggtatcaatggtagattatattacggtgacaatctcgggatgatccgcatatgagtagatgtggattagggcggagtagcggcaggactaataataaccggcggcgagaaatacataattgaggggctattcataaatcatcatctagaaacgcaagcactatcatgaatatatcataagtaatttacgttggtaatgatggctcagcaaacccaacaagctttacaggaacaatttttacgcttcagagccaaataaaacggcggcattgccgccgtataacttatttattgtttcttagtaaaacgaatcttatatgctctgaaaaaacaaaggaagatgcaatgtataccataaaagcaatcatcaaatgctcagggaacaaccatcccatgctaacaggaatcacacttattccaatgcaaaataggaacattatgaaataatgcgctgactttgtttcctgagttttattggagaaatacttagctaggacgcctttaaatactccagatataactaaccaaactggtgtaaaaagcccgaaatctgcgtatagttcaccatacccgaaagcaggagcgccctgatttctgtagaatgcatcagggaaaaatacttttgccagatacaatgcgccaaaatcttcaggcttatcaggccaaatagccctcggaatcctcgagtaaacctcgctctccattagtaattttccgtacataaagtcaaagtttgaggaagcaacaagaacagcattacgggtataatccgagtaattagccatattttctatcggattcccatcagtaaacgtatatgcaaagaatgccgttacaatgactgctataacagcaaacgattttaccaggaacataaatttaatttttttattttcaatatatgaaaggtaaaggatgaatgctataaatatactaaatattggtcctttgttaccatgcaagaaaataagtatacagttaaataaaactatggaaatacaaaataactttgattttttgtatgtaaagaacgcgcaaatagaagcgacaagagaaaacattaatgaaggatagaagtatataccataccctgttctggttaattcgtatattcttcttgggctaagtatatactctctgaactccatcaacactggaaggtaaatgataaaagcaaggaaggtgaataacaatgaagtaaacacataccttggtttatttttcgtgtttgatttgttgtatatgggttttctttgtgtgtaaagataagaaataacaaatgatgctatgtatgttatatagcaagtatagaaaaacaaatattccactgtataattctgcacctctgagaggtatacaaatataccttcaaacacgtacagtgtagggactgttattatcaggtatgggaccattacatttattatttttccctcaattcttacggaaagagtatagagataaactataaataataagcataatgcaatgtatgaaattataagcatatagagcctttagaaaaaatgcttagtattaaaaatattaccatcaggcaaataaggtgtggtacggaaaatcttctggcaagatattctgaatctggtagtctataatcattactcatcactatcttcccgatatcaaaaccgtgttattgaaatattaacactcattaacactcctatctactgcgcctccgatagcatgaagctatcaagcgtttgcagcacaaacatcaaacaatgtaaatgcttttgataattacgcatgattgttactgtgtttatatacagtggcattcgaagattcatcatgaggttcccgagtcctgtaaaagactatacagagaaagagctatcactcgacgagtaattcatctcacatcgtgccgcgacatacttcaagcaacacagacgaattacaagtacggcatcataagtgagacgttgctagttatagaagcttcatagcagcatgtaatggctctttgctggtatgtgctttggaaagtgggtttcgtattgtgcgttatcgcatgctgccaggtccccatctggagaatatagatagcggtcgtcgtgaaaagctatctgatgtgaatgcctcatacggtggcagtaagccgagattcagagtgaccatgtacatcattaacgatacgcgtgccgggtagtgtgttgggattcaggttctgtagaacagaaagatgcaatctccctttttttagtgttaccatcatcatgccggacgaaaatagcgattttcgtctgtgtcgaaggttgtgcgccaatttagcaatggttggctagatggatacacaactcactgtcaataaattcattttctctttgtatgtgatcttgcgtatgggtcaccactgcaaataaggatattacatgcctgttattactcttcctgatggcagccaacgccattatgaccaccctgtaagcccgatggatgttgctctggacattggtcctggcctggcgaaagccaccattgcgggccgtgtgaatggcgagctggttgatgcttccgatctgattgaaaatgatgcgacgctttccatcatcaccgcaaaagatgaagagggtctggagatcattcgtcactcttgcgcgcatctgttaggtcacgctatcaagcaactttggccgcacacgaaaatggcgatcggtccggttgtcgacaacggtttttactatgacgttgatcttgaccgcacgctaactcaggaagatgtcgaagcgctcgaaaagcggatgcatgagctcgccgagaaaaattacgacgttatcaagaagaaagtcagctggcacgaagcgcgtgaaaccttcgtgaagcgtggtgaaagctacaaagtttccattcttgatgaaaacattgctcatgatgacaagccaggcttgtaccatcatgaagaatatgtcgacatgtgtcgtggtccgcacgtgccgaatatgcgtttctgccatcactttaaactgatgaaaactgccggcgcatactggcgcggtgacagcaataataagatgttgcagcgtatttacggtacggcatgggcagataaaaaagccctgaacgcttatctgcagcgcctggaagaggccgcaaaacgcgaccaccgtaaaattggtaagcagctcgacctgtatcatatgcaggaagaagcgccgggcatggtgttctggcataacgacggctggactatcttccgcgagctggaggtctttgttcgttctaaactcaaagagtaccagtatcaagaagttaaaggcccgttcatgatggaccgtgtgctgtgggaaaaaaccgggcactgggacaactataaagatgcgatgttcaccacatcttcagaaaaccgcgaatattgcatcaagccgatgaactgcccgggccacgttcagatctttaaccagggtctgaaatcctatcgtgatttgccgctgcgtatggcggaattcggtagctgccaccgtaacgagccatcaggcgcgctgcatggtctgatgcgcgtacgcggctttacgcaggatgatgcgcatatcttctgcaccgaagagcagatccgcgatgaagttaacgcttgtattcgtatggtctacgatatgtacagcacctttggcttcgagaagatcgtcgtcaaactttccactcgtcctgataagcgtatcggcagcgatgagatgtgggatcgtgctgaggcggatctggcggttgcgctggaagaaaataatatcccgtttgagtatcaactgggtgaaggcgcattctacggtccgaaaattgaatttaccttatatgactgcctcgatcgtgcatggcagtgcggtacagtacagctggacttctccttaccgtctcgtctgagcgcctcctatgtaggcgaagacaacgagcgcaaggtgccggtaatgattcaccgtgcgattcttgggtcgatggaacgcttcatcggtatcctgaccgaagagttcgctggtttcttcccgacatggctcgcgcctgttcaggtagtcgtgatgaatattaccgattcgcagtctgaatacgttaacgaattgacgcagaaactacaaaatgcgggcattcgtgtaaaagcagacttgagaaatgagaagattggctttaaaatccgcgagcacactttacgtcgtgtcccttatatgttggtctgtggtgataaagaggtggaagcaggcaaagttgccgttcgcacccgccgcggtaaagacctgggcagtctggacgtaaatgacgtgattgagaagctgcaacaagagattcgcagccgcagtcttcaacaactggaggaataaagtattaaaggcggaaaacgagttcaaacggcgcgtccgaatcgtattaatagcgaaattcgcgcgcaagaagttcgcttaacaggtctggaaggcgagcagcttggtattgtgagtctgagagaagctctggaaaaagctgaagaagccggagtagacttagtcgaaatcagccctaacgccgagccgccggtttgtcgtataatggattacggcaaattcctctatgaaaagagtaagtcttctaaggaacagaagaaaaagcaaaaagttatccaggtgaaggaaattaaattccgtcctgggacagatgaaggcgactatcaggtaaaactccgcagcctgattcgctttctcgaagagggcgataaggccaagatcacgctgcgtttccgcggtcgtgaaatggcccaccagcaaatcggtatggaagtgcttaatcgcgtgaaaaacgatttgcaagaactggcagtggtcgaatccttcccaacgaagatcgaaggccgtcagatgatcatggtgcttgctcctaagaagaaacagtaaggccttcaagtaacaattctgtgaagccttcgggcttcacaggttttgttcgcctatgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcacattctgaccaaaaaagcgactaaacgtaaacgtcacctgcgtccgaaagccatggtttctaaaggcgatctgggcttggttatcgcgtgcctgccgtacgcataagccgttaacgtttttaactttttaattagaatagatacaggagagcacatatggctcgcgtaaaacgtggtgtaattgcacgcgcacgtcacaagaaaattttgaaacaagccaaaggctactacggtgcgcgttctcgcgtataccgcgttgccttccaggcagttatcaaagctggtcagtatgcttaccgtgaccgtcgtcaacgtaagcgtcagttccgtcaactgtggattgcgcgtatcaacgcagcagcacgtcagaacggtatttcttacagcaaattcatcaacggcctgaaaaaagcctctgttgaaatcgaccgtaagatcctggctgatatcgccgtattcgacaaagtcgcgttcaccgcgctggttgaaaaagcgaaagcagctctggcataagccagtgaaaagagggagcctggctccctctcttttatttactgttcagtgagttgacaattgacctgtaacccttttcaataaaggatattcggttttaccacataaggtaacgcaagcatgaacgctgctattttccgtttctttttttactttagcacctgatcccaggaggctagcgcgtgaaaaacgaaacgaaaaacagcgtaaaaaagcctcctgatggaggctttttttgtatctgaaatcgagagattacgtccaatgaaccggtgtcttcaccgacacaatgaggaaaaccatgtcacatctcgcagagctggttgccaatgcagcggccgccattaaccaggcgtcagatgttgccgcgttagacaatgtacgcgtcgaatatttgggcaagaaagggcatttaacccttcagatgacgaccctacgcgatctgccgccggaagagcgtccggcagccggggcagtcattaacgccgcgaaagagcaggtacaacaggcgcttaacgcgcgtaaagccgagctggaaagcgcagcgcttaacgctcgtctggccgctgaaactatcgatatctccctgccgggacgccgtattgagaacggcggtctgcatccggtcacgcgtaccattgaccgtattgaaagtttcttcggcgagcttggttttaccgtggcgactggcccggaaatcgaagatgactaccataacttcgatgcgttaaacattccgggtcatcacccggcccgcgccgatcatgataccttctggtttgacgcgacccgtctgctgcggacccagacgtctggtgtccagatccggacgatgaaagcgcagcaaccgccgatccgtattattgcgccgggccgtgtataccgtaatgactacgaccagacgcatactccgatgttccatcagatggaaggtctgattgttgataccaacatcagcttcaccaacctcaaaggtacgctgcacgacttcctgcgtaatttctttgaggaggatctgcagattcgcttccgtccttcttattttccgttcaccgaaccttctgcggaagtggatgtgatgggtaaaaacggcaaatggctggaagtgctgggctgcgggatggtgcatccgaatgtgctgcgtaatgtcggtatcgatccggaaatctattctggcttcgcttttggtatggggatggaacgtctgaccatgttgcgttacggcgtcaccgacctgcgttcattcttcgaaaacgatctgcgtttccttaaacagtttaaataaaggcaggataaaacaatgaaattcagcgaactgtggttacgcgagtgggttaacccggcaattgatagcgatgcgttggctaaccagattacgatggctggcctggaagtagacggcgttgagccggtcgcgggaagcttcaatggcgttgtggttggggaagtggttgagtgcgcccagcatccgaacgctgacaaattgcgtgtaacgaaagtcaacgtcggcggagaacgcctgttggatatcgtctgcggcgcgccaaactgtcgtcaggggctgaaagtagcggtggccactattggcgctattctgccgggcgatttcaaaattaaagcggcgaaactgcgcggcgaaccgtctgaagggatgctgtgctccttctccgaactggggatttccgacgatcacagcggcattatcgaactgccggcggatgcgccgttgggtaccgacatccgtgaatacctgaagcttgacgacaataccatcgaaattagcgtcacgccgaaccgtgcggattgcttaggtatcatcggcgttgcgcgtgatgtggcggtactgaacaaagcgccgctccaggagcctgaaatggcgccggttacggcaaccatcagcgatacgctgctgattacggtagaggctgttgatgcgtgtcctcgctatcttggccgggtggtaaaaggtatcaatgttaacgcgccgacgccgctgtggatgaaagagaaactgcgtcgctgcggtattcgctccatcgatgcggtggttgacgtcacgaactatgtgctgctcgaactgggtcagccaatgcatgctttcgataaagatcgcattgatggcggtattgtcgtgcggatggcaaaagagggtgaaaccgtcgtcctgctggacggtagcgaagcgacgttaaatgcggacacgctggtgatcgccgatcaccataaggcgctggggatagccggtatttttggcggcgaacattccggcgtgaacggcgaaacgcaaaatgtgctgctggagtgtgcgtactttaatccgctgtctatcaccggtcgcgctcgccgccacggtctgcataccgatgcgtctcaccgctacgagcgcggggtggacccggcgctgcaatataaaacgatagagcgcgctactcgtctgcttcttgatatctgtggcggtgatgcgggtccgataattgatgtgagcaacgaagcaacgttgccgaaacgcgccaccattactctgcgtcgcagtaaactggatcgcctgatcgggcatcatattgcggatgagcaggtcagtgatattctgcgtcgtctgggctgtgaagtgaccgaagggcaggacgagtggaaagccgtggcgccgacctggcgtttcgatatggagattgaagaagatctggtggaagaggtggcccgcgtttacggctataacaatattccggacgagccaatccaggccggtttaatcatgggaacgcaccgtgaagccgatctgtcgttgaagcgggttaaaaccatgctgaacgacaaaggctatcaggaagtgattacctatagctttgtcgatcctaaagtacaacagctcatccatccaggcgcagaagcgctgctgctgccaaaccctatctccgttgagatgtcggcgatgcgtctgtctctgtggagcggattgttggcgacggtggtctataaccaaaaccgtcagcagaatcgcgtgcgtatttttgaaaccggtttacgtttcgttccggatacacaagccaatctgggtattcgacaggatctgatgctggctggcgtgatttgcggtaaccgctatgatgagcactggaacctggcaaaagagaccgttgatttctatgatttgaaaggcgatctggaagcagtattggatttaaccggcaaactgggtgatatccagtttaaggcggagatgaatccggctctgcatccgggacagtctgcggcgatttatctgaaagatgaacgtattggttttattggggttgttcaccctgaactggaacgtaaactggatctgaatggtcgtacgctggtgtttgaactggaatggaataagctcgcagaccgtatcgtgccgcaggcgcgggagatttcacgcttcccggccaaccgtcgcgatattgcggttgttgttgcagaaaacgttcccgcagcggatattttatccgaatgtaagaaagttggcgtaaatcaggtagttggcgtaaacttatttgacgtgtaccgcggtaagggtgttgcggagggttataaaagcctcgctatcagcctgatccttcaggataccaaccgtacactcgaagaagaggagattgccgctaccgtcgccaaatgtgtagaggcattaaaagagcgattccaggcatcattgagggattgaacctatggcgcttacaaaagctgaaatgtcagaatatctgtttgataagcttgggcttagcaagcgggatgccaaagaactggttgaactgtttttcgaagagatccgtcgtgctctggaaaacggtgagcaggtgaaactctctggttttggtaacttcgatctgcgtgataaaaatcaacgtccggggcgtaacccgaaaacgggtgaagatattcctattacagcacggcgcgtggtgaccttcagacccgggcagaagttaaagagccgggtcgaaaacgcttcgcccaaagaagagtaatcagatccaggcataacatccatcagggtgtattgcggcagatacgctgccatcccgaaagtagatcagcgggatgacagcgtatttgtcagcctgaaagatgacccgtataactaaaaaggccgcattgcggccttttttctttcaagtaaaggatacccaccgtaaaatcacgctacctcttttcagctgaatggataacatgctgacttttgcccgccaacaacagcgacgaaacgttcgctggcttctgagcctgtcactgctggtgctactggctacacttctgagcttatgcgcaggcgaacagtggattgcccccggtgactggttaagcgcccggggggaactgtttgtctggcaaattcgccttccccgcacgcttgcggtattgctggttggcgctgcgctggcgctatctggcgccgtgatgcaggcgctgtttgaaaacccacttgctgaaccgggtctgctcggcgtttcgaatggggccggtgttgggcttattgccgccgtcttactggggcaggggcaactgccaggatgggcgctggggctgtgcgctatagccggcgcgctcattattacgttaatcctgctgcgttttgcgcgtcgccatctctctaccagccgcttgttgttggcgggcgtcgcgctgggcattatctgtagcgcgctgatgacgtgggctatctatttttccacctctttcgatctgcggcaattaatgtactggatgatgggaggatttggcggcgttgactggcagcagagctggctaatgattgcgctcatcccggtactgatctggatatgttgccagtcgcaaccgctgaatatgctggcgctaggggaaacctcggcgcggcagcttggcctgccgctgtggctctggcgcaatttgttggtcatcgccaccggctggatggtgggcgtcagcgtagcgatggcgggggcgattggttttatcggtctggttattccgcacatcctgcgcttatgtggtttaaccgatcaccgggttttacttcccggctgcgcgctggccggggctatcgccctgctattggctgatgtggtcgcccgactggcgctggcgtcggctgaactgcctatcggggtggtcaccgccacattgggggcaccagtgtttatctggctgctactcaaatccgcgcgttagcgcatcggtaaacaactgctttcatcattcgcagtctatgattaaaggctaacgatgaaacccgctattctaccgacatcagggagacaccatgcaaaactcgcttcttaatactcacgttacgacgattgatggagaggtcactacacttgaaaaatacgccggaaaagtgctgctcattgtaaacgtcgcctccagatgtggcctgacgccgcaatatgaacagttggaaaatatccagaaggcgtgggcagatcaggggtttgtcgtgttgggttttccctgcaaccagtttatggggcaggagccaggcagcgaagaggagattaaaacctattgtgccagcacctggggcgtcacgttcccgatgttcagtaaaattgatgtgaatggcgacgcgcgccatccgctgtatcaaaaactgatagccgctgcgccaacggcagtcgcgccggagaagagcggcttttacgaacggatggtaagcaaagggcgtacgccactctatccggatgatattctgtggaattttgaaaaatttttggtaggccgggatggtcaggtggtacagcgtttttcgccggatatgacgcctgaagatcctattgtgatggaaagcataaaaatcgcgttggcaaaataatgtctcaattgatgcaattaaaggacgtcgccgagagcacccgcctggggccgctttccggcgaagtaagcgcaggagagatccttcatcttgtcgggccgaacggcgccgggaaaagcacgctactggcgcgtatggcggggttaacctccggcgaggggagcatcaggtttggcggagcgccgctggaggcatgggcgacggcaacgcttgcccaacaccgcgcttatcttgcgcaacagcaaaatccgccgttcgccatgccggtctggcattacctgacattgcatcaacctgataaaacgcgaaccgggcagcttaacgaggtggccgatatgcttggattgggcgacaaactggggcgaagcgtgaatcagctttccggtggcgagtggcagcgcgttcgccttgctgccgttgtactacaaattcatcccgacgctaatccggtcggtcaattattgctgcttgatgagccgatgaacagtctcgatgttgcgcaacaaaacgctctggatcgggtattacatcatttatgtcaggcaggaattgcgattgtgatgagtagccacgatctgaaccacacgctgcgccatgcgcataaagcctggttactaaagcgcggtaaactcattgcctgcggccgccgggaagaggtgctcaccccctcttatctggcgcaagcctacggtttgcgctttcgacgactcgacgtcgaggggcatccaatgctcatttcggccacttaagtaaaatcgtttcttgaaaagcaggtaatttcgacgctaaattaataccaaaataaaaacagaggattgttgcggcatgcgtttttggcttcttgttatcacagcattgttcctggcaggatgcagtactcatcgggcaccggcgccaaatgccagattatcagactccattaccgtcattgcgggtctgaacgatcagttgcagtcctggcgcggtacgccataccgctacggcagcatgagtcgcagaggcgtggactgttccggctttgtggtagtcactatgcgcgacaagtttgatttgcagttgcctcgtgatacgcgtgaacaatcaaaaatcggcaccagaatcgataaagatgaattgctgcccggagatttggttttctttaaaaccggttcgggcgaaagtggtttacatgttggtatttacgatacaaataatgagtttattcatgcctctaccagtcgtggcgtgatgcgttcatcgctggataatgtgtactggcgaaaaaacttctggcaggcacggcgaatttaacctcgcagacgatataaattttatagtctatttttaacatatcgccagttgaacttatgacatctgttgtcatcatatataatgatataaccgtagcatttacaaacgtacttttattaaaaacgggcgtgctcacgccctgttaaaagtacaacattggatattggtttataatcagagtaagttaaaaaaaggaaccggttcaccggtaaacaagaaaaatgatgacgcttcaattagtatctgaagttacgtctgtttccgtccgtagtgactggatggtgaatagcgccctaaccatgggactggcgtaatgattgcttcacttgatgagctttaccattccgaactctttttccttcccgtcatggatgaaaacgctcggcttgttggtttagagattattgcaacgtttgccgctgaagacggcgccgtgcggatgccgactgagttggtagcgcctcgcctttcggtggaggaacaatactgtctgtttgttgaaaaactggcgttgttagaaacctgtcagcacttttttattcagcataaacttattgcatggcttaatttaccgcctgcaattagtgacttattattattagatagcgaacttttttcccgggcagcgcgctttccgttttttgaagtagctataaatgagaattatcctgggttaaaccagggcaaaaacaatgaaacgttagctaatctggcaatgcatttcccattaattttggcaaattttggggcaggcgaggcgtcgactaaagctattttcgatgggcttttcaaacgagtcatgttggataaaaattttattcagcagcgagctgaaatgatctcattcgaaccattcatgcacgctattgttgcccagatctcctccagctgcgagtcgctgatgattgccggtattgatactgaggcgatgtttgcgcgcgcagcgccattggggtttagcgcattccagggcggactatggcctccggtgccggtaagccagctcattaaactcgttcagcgataacctttctgtttgccggtgtttaaccggtgattaaccgtctacactgaagacaggaggccctatgaccctgtcttttactgcccgttggcgcgatgaattgccagcaacgtataccgcgcttttacccacaccgttaaaaaatgcgcgactgatttggtataacgacgaactggcgcagcagttagccattcccgcttcgttatttgacgctaccaatggcgctggcgtttggggcggcgaaaccttattacccggtatgtcgcctgtcgcgcaggtatatagcgggcatcagttcggcatctgggcgggacaactcggcgacggacgcggtattttgctgggcgaacagctcctggcggatggctcgaccctcgactggcatctgaaaggcgccggattaacaccctattcgcgaatgggagatggacgcgccgtcctgcgttcaaccatacgagaaagtcttgccagcgaagctatgcattatctgggtattcccactacgcgcgcgttatctatcgtagccagcgatacgccggttcagcgagagacgcaggaaacgggcgcgatgttaatgcgtctggcacaaagtcatatgcgttttggtcatttcgaacatttctattaccgccgtgagccggaaaaagttcagcaactggctgatttcgctattcgccattactggccgcaatggcaggatgtagcggaaaaatatgctttgtggtttgaagaggtggcggcgcgtaccggaagactcatcgccgagtggcaaaccgtcggtttttcgcacggcgttatgaatacggataacatgtcgattctggggctgaccatcgactatggcccctttggttttctcgacgactacgatcccggcttcattggtaaccattccgatcatcagggacgttaccgcttcgataatcaaccgtcggtggcgctgtggaatttacaacgtctggcgcagacgttaaccccttttattgagatcgacgcgttaaacagagcgctggatcgttaccaggacgcgttgttaacgcactatgggcagcgaatgcgccagaagctgggcttctttaccgagcaaaaagacgataacgctttactgaatgaattgtttagtctgatggcgcgcgaagggagtgattatacccgtacatttcggatgttaagccatacggagcaacagagcgcctcctcgccgttgcgggatacgtttatcgatcgcgcggcgttcgatgcctggttcgaccgctaccgggcgcgattgcgcacagaggcggtggatgacgcgctgcgccaacagcagatgcaacgcgtgaatcctgcgattgtgttgcgcaactggctggcgcaacgcgcgatagatgcggctgaacaaggagacatggcggaactgcatcggttgcatgaagttttacgtcaaccttttaccgatcgagatgatgactatgccagccgaccgccggagtggggaaagcggctggaggtcagttgttcaagttagccagatgccagcagaatcgtctgctggcgggagcgctatttggttaacagtagcttaccggcctgagttttgcgcaacagatactcctgaccgttgtgatcgataatgactttgccgtccggacctaatagcgcctgactgttgacgcgccgttcagcggcagggagaagcgtttcattgtctatttccttagggtgaggcagctcggtgttatccatacgcgacatgttatttattaataatcaaactcacaatgattattattatcaataattaatgcgataacagcaagtgctaattctgtggagtgatatacgcgcgcgtagagaaaagggtgggtaacgcatcgaagaaacgcccatcccggcaggatgggcgagctattaaaagcggctgtctaccgccgcggcaagtttttccaacagaacttccgtatcttcccagttcaggcagggatcggtaatggattgaccatagattaacggttgaccgctgataattttttgcgtgccttcccgtaaaaaactctctgccataatcccggcaattgccgtggagccattacgaatctgctggcaaatatcatcacatacgtccaactggcggcgatgctgtttttgacagttgccgtggctgaagtcgacgaccagatgttccggcagatcaaattcatgcaacgtgtcgcaggcggcggcaatatcttcagcgtggtagttcggttttttaccgccgcgcatgatgatgtgcccatacgggttgccactcgtttggtagatagtcatctgtccgtctttatccggcgagagaaacatatgactggcgcgggaggcgcgaatagcatcaacggcaatgcgggtattgccatccgtaccatttttaaagccgaccgggcaagagagcgcagaagccatttcccgatggatttggctttcggtggtacgcgcgccaatcgttccccaactgatcagatcggcaataaactggccggtgaccatatcaagaaattctgtggcggtcggtactcccagttcgttcacctgcaatagcaagcgacgcgccagttcaagcccatgattgacgcggtaactgccattcaagtcgggatcggaaatcaggcctttccatcccacgacggtgcgcggtttttcaaaataggtgcgcatgacgatttccagacgcgcctgatgcttttggcgttgtgcctggagctgcgtcgcgtattccatggcagcattcagatcgtgaatcgaacaggggccaatgacgaccagtagccgtggatcttcaccatttaaaatcttttctatccggcgtcgggagtcggtaacgtgactggcgacggaggacgatacaggataccgctgcgcgagttcggttggtgttaccaggctgtcgatacgcgcagtacggagttcgtcggttctgttcattacaagtctcagaaatttgttgtttcaacggcaggactaccgggaagtgatgggcatcacgataaaccaatccctgctgatttcaagtgcgaggcgtgtcacacctcgcaggcagaacggcatgataacaaaaaccaatccattaaactagtttactagtacatcctgcggttaagccccataatatcgagaatcttggtggctatctcttcaacggaataattggtgctgttcaggcaggggatctgattcttacgatacagcgcttcgacctccgccacttccatgcggcactgacgcaacgaggcatagcgactgttttcacggcgttcttcgcgaattgccgccaggcgttcagggtcaattgtcaggccgaacagtttatgttgtagcggttttaacgatgtgggcagcgtcaaattatccatatcatcggcgatgaaagggtagttagccgcacgaataccgaattgcattgccagatagagactggtgggcgtttttccacagcgcgaaacgccaagtaaaatgacctgggcctgatcgaggttgcgcaatgaaatgccatcatcatgcgccagggtataatcgatagcggcaatacgggcgtcatacttgttcaggttacccggattaagcccatgagtacgatgagcgatcggcgtcggatccagtttcatctcctgctgaagcggcgccaccagcgcctggacgatatcctggcagaagccttcgctctgcaagatgatggcgcgaatttcaggtaaaacaatcgagtaaaacaccagcgggcgaacgccggtttgctgataaatggcgtcaatttggtctttgacggcgcgggcgcgactttcgttttccacgaatggcagcgtgatgctgctgatcgtcaccggaaactgcgacataaccgcgtgacccaggacctcggcggtgatggcggtaccatcagaaatatagaaaacatggcgatcaacaacattatccattctgttcatcctgaagagtaaacataattatctgaaagcataaattaaaagtaacgggaaacgtataacttgtcgcttattttataaaatgacaggcactttttataattaatgaaaagtgtgtttcatttccttgaaacgcagtttatgccgggagtgattaagggaatgccgtgctatgcgcgggtttgcgcaactacgtaaacaatctgaaaaaatgaaaaaataaatttgcttgaacgattcaccgtttttttcgcgggtttaagtatgccaggataaatacgcaactatgtgtttcttaaactcgttcatttatcacaaaaggattgttcgatgtccaacaatggctcgtcaccgctggtgctttggtataaccaactcggcatgaatgatgtagacagagttgggggcaaaaatgcctccctgggtgaaatgattactaacctttccggcatgggcgtatccgttccgaatggttttgcaaccactgccgatgcgtttaaccagtttttggatcaaagcggcgtaaaccagcgcatttatgagctgctggataagacagatattgatgatgtctcccagctggcgaaagcgggcgcgcagatccgccagtggattatcgacactcctttccagccggcgctggaaaacgccatccgcgatgcctatgcgcagctttcgtcggatgatgaaaatgcctcttttgccgtgcgttcctccgccacggcggaagacatgccagatgcttcgtttgcgggtcaacaggaaacgtttcttaacgttcagggcttcgatgcggtactggtggcagtgaaacacgtatttgcttctctgtttaacgatcgcgccatctcttatcgcgttcaccagggatatgatcatcgcggcgtagcgctttccgctggcgtgcagcggatggttcgctccgatctcgcctcgtcaggggtgatgttctctatcgataccgaatccggctttgaccaggtggtctttatcacctcggcatggggactgggtgaaatggtggtgcagggcgcggttaacccggatgaattttatgtccataagccaaccctggcggcaggccgtccggccatcgtacgccgcaccatggggtcgaaaaaaatccgcatggtttacgccgccacccaggagcacggtaagcaagtgaagattgaggatgtgccgcaggaacagcgcgacattttctcgctcaccaacgaagaagtgcaggaactggcgaaacaagcggtgcagattgagcagcactatggtcgtccgatggatatcgaatgggcgaaagacggtcataccggtaagctctttattgtgcaggcacgtccggaaaccgtgcgctctcgtggccaggtgatggagcgttatacgttacatgcgcaggggaaaatcattgccgaaggtcgtgccattgggcatcgtatcggcgcaggtacggtaaaagttattcacgatatcggcgaaatgaaccgtattgagcctggcgatgtgcttgtcaccgatatgaccgacccggactgggaaccgatcatgaaaaaagcggcggcgattgtcactaaccgtggcgggcgcacctgtcacgcggcgattatcgcccgcgaattgggcattccggcggtagtcggctgcggcgacgccaccgaacgcatgaaagatggcgaaaaagtaaccgtctcctgtgcggaaggtgataccggttatgtgtatgccgacatgctggatttcagcgtaaaaagctccagcgtagataccatgccagagctaccgctgaaggtcatgatgaacgtcggcaacccggacagggcatttgactttgcctgcctgccgaatgaaggcgtaggtctggcgcgactggaattcatcattaaccgtatgattggcgttcacccgcgcgcgttgctggagtttgacgaccaggatgccgcgctgcaaaacgacattcgtgagatgatgaaagggtttgactcgccgcgtgaattttacgttggtcgactgacggaagggatcgcgacgttaggcgccgccttctacccgaaacgcattatcgttcgcctgtctgactttaagtccaacgaatacgccaacctggtcggcggcgaacgttatgagccgcatgaagaaaacccgatgctgggcttccgcggcgcgggtcgttacgtcgcagaaagtttccgcgattgttttgcgctggaatgcgaagcggtgaaacgcgtgcgcaacgatatgggccttaccaacgtcgaaatcatgatcccgttcgtgcggacggtcgaccaggcgaaagcggtcatcgaagagctggcgcgccagggacttaaacgcggcgagaacgggctgaagatcatcatgatgtgcgagattccgtccaatgccttgctggctgaacagttcctcgagtattttgatggcttctcgattggttctaacgacatgacgcagctggcgctggggctggatcgcgattccggcgtggtgtctgaactgtttgacgagcgtaacgacgcggtgaaagcgctgctatcgatggcgatccgcgcggcgaaaaaacagggcaaatatgttggaatttgcggccagggcccgtccgaccatgaagactttgccgcctggctgatggaagaggggatcgacagcctgtcgctgaacccggacaccgtggtgcagacctggctgagtctggcggaactgaagaagtaaaccgcgaccagataacgctatgcttatccggcctgcacaagaaacatgttgtgtcggccggatagggcgtaagttgcccgacgcctgcataatgccggatcaggcgttgtgcagaatcattaatacactgcgtagatcatttacggcgatttgccccggcgctgaagcctgcttcaccgcgccaaacgtggcggcagagccaaacacttcccctgccagacgtgaaatgacaccctctttcgccattgacatagtaattaccggacggtcggcgtaatgttgctgcatctccagcgtggcagtgagtaacgttaatacatcatgcttgctttgcggcataacggcaatcttgggaatatccgcgccgagtgcttgcattttacgtagccgcagaaccatttcctctgcggacggcgtctggtgaaaatcgtggttagacatcacgacataaacattatgcgcatgggcataatcgacagtggctttaacgtcagcatcaccggtaaatagctcaagatcgatcatatcgaccaggccgctgtcgattgcggcacgattaagcgtgagataatgctgagtggttattgtctgctcgccgccttctttggcgctgcggaaagtaaacagtaacggaatgtcaggcatcgcatcgcggataacacgcgcagcggtaagaacggattgagtcgatgcgatatccataaagtgatccacgcgccactccagaatatcgaatgtagcttcgcggtaggccagcgcctccgctttcacgctattgatgtctcttcccatcaacgacacgataattttgggcatcccttcgccaatgataagattttttacggtgacggttttcatgcgtgtcctgtcagttttttttcttctcgccattatgaacggtgaggctggccgcttgaagtaaaaaaaaaagcccatcgtaggagacgggcaaagactacacacagcaattcgttgtttcactcaggggatttccatgcttataaatcaatgtgttgatttataaccgtgtgctaatagtaggcatgagcactttttgcgtcgatcagattcgtctcaatagtttaaaaactgtaacggatttgcgacagaaatgagatgcggcggggaacagacgggcgaatcaaaatggggtgtgcgttgaattgataaacgtcgctaaagcatcgggcggcaatgccgcccgacgggattatgactgcttgttggcttcctcgatgtcatccagctcttcaaggatctcctctggttcattcgtcggcgccggaacttcatgtacccatgcggagaacaaacgccaggtcacggccagaagcaccggtccaataaacagaccaatcataccgaatgcaatcaggccgccgattaccccggaaaggatcagaagcagcggtaaatcggcgcccatgcggatgagtaccgggcgaatcacgttatccagagtgccgacgacggcgctccaaaccagcagcacggtgccccaggtggtgtcgcctgtccagtaaagccagataatggctggaatcaataccggcaacggccccaactgaaccaggcacgaaaggatcatcactaccgtcaacagggtagcgtaaggcacgccggaaatcgccagcccgacgccgccaagtaccgcctgtaccagcgcggtgaccaccacgccaagcgccacggcgcggatcgcctgggcagccagcagaaccgccgcatcgccgcgtttagccgcgagacgacaggcaaaatggcgtatacccatcgccacttgttcgccgcgccagtaaagcagggcgctaaacaacagcatcagggcgcagtgcatcataaagcgtccgatatgcgccgcctgaccgacaaaccagatcgtggttgtgccgatataaggccgcactttcgccataatagcgctaccgcccatatccagcaggctatgccatccggcatacagtttggcgccaactaacggaatattatttaaccatgccagatcgggtagcgtcatatcgccgccggtcactgcatggatgagcgggccgctaccatcgacaatgctgttcaccagcaaggcgacgggaataacgaagagcagcactaacagcagcgtcatgaccagtacggcaagcgagcggcggccccacaatattttttgtaatttcagcaaaacgggccaggtcgcgataacaatcgtacctgcccatgcaaaccccaaaataaaaggctgtactatccacaaacaggccacaatcatgatggctaaaaacagcaccgatagcagcacttgcgcaatatccctgggctgacgaacatttaccataaatacttttcacctttgtctttgcgccagaacgttggcgcgacgtgaacatgcaaaccacaccctataatgatgagcaatttcagcggtttttaacaggccgattctgcatgtaattctgttgggcgcacaggaaaaaaatgtgatacaacaaataacgcaacacgcaaacgattaagcatcccttcctgtgcgtagaccgctcgcgctcgccgggttgggcgccaccgttcacaacatagaccgcaggaaaaggtcaatataatgattccacaaatttctcaggcacccggcgtcgttcagctggtgctcaattttttgcaggcgctggagcagcaagggtttacgggcgatacggcaaccagctatgccgaccgtctgacaatgtcgaccgataacagtatctaccagcttcttcccgatgctgttgtgtttccccgttctacggcggatgtcgcgcttcttgcccgtctggcggcggagccgcgctttacgtcgctgatatttaccccgcgaggcggcggtactggcacgaatggccaggcgctaaaccagggcattattgttgatatgtcccgctatatgaaccgcattattgaaattaatcctgaagagggatgtgtgcgggtagaggcgggagtgataaaagatcagcttaatcaagcgttaaagccgtatggctatttttttgcgccggaactttccaccagtaatcgcgccacgcttggcggtatgattaataccgatgcctctggtcagggttcgctggtctatggaaaaacgtcagatcacgtcttaggcatacgggccgtattgttggggggcgatatccttgacacgcaatcgatgcccgtagatcttgcccggacgctgggtgaaaacacgacgacgccaggccgcatctatcagaccgtctatcagtcctgcctggaaaaccgtcaacttatcctcgatagctttccaaagctcaatcgcttcctgacaggctacgatttacgccacgtctttaacgatgacatgacccgcttcgatctcacccgcatcttaacggggtcggaagggacgctggcgtttattactgaagcccggctggatattaccccgatacccaaagtccgccgtctggtgaatgtaaaatacgactcctttgattccgcgctgcgtaacgccccttttatggttgacgcgcgcgccttatccgtcgagacggtcgattccaaagtccttaaccttgcgcgggaagatattgtctggcactccgttagcgaattgattaccgatgtgccggataaagagatgcttggcctgaatatcgtggaattcgcgggtgatgatgaagcgcttattgacggacaggtcgaggcgctgtgccaccgactggatggcctgatggcgcgtgcggaagcgggcgtgatcggctggcaactttgtaccgatttgacgggtattgagcgtatttacgcgatgcgtaaaaaagcggtagggctgctgggtaatgcgaaaggcgctgccaaaccgattccttttgcggaagatacctgtgtgccgcctgaacatctggccgattacatcgccgaatttcgcgctctgctggatggtcatggcttaagttacggcatgttcggccacgtggatgccggggtgctgcatgtgcgcccggcgctggatatgtgcgatccgcagcaggaactgttgatgaaacagatctccgatgaggtcgtcgcgctgaccgccagatacggcgggttgttgtggggcgaacatggaaaaggtttccgtgcggaatacagcccggcctttttcggcgaagtcctgtatggcgagctgcgcaaaataaaagcggcttttgatccgcataatcgacttaacccgggtaaaatctgtccgccgcaggggatagaggcgccgatgatgaaggtggatgcggtaaaacgcggcacctgggatcggcaaatcccgctggcggtgcggcagacctggcgcggcgctatggagtgtaatggtaacggcctgtgctttaatttcgatgcgaaaagcccgatgtgcccgtcgatgaaaattagccttaaccggatccactcgccgaaagggcgggcgacgctggtgcgggaatggctccgtctattggccgatcgcggcgtcgatccgttgaagctggaaaaggagctgccggaaaaacgcgccagcttgcgcacgctgattgcccgcacccggaatagttggcacaaacgcaaaggcgagtatgacttttcccatgaagttaaagaggccatgtccggctgtctggcatgtaaagcctgtacgacccagtgtccgattaaaatcgatgttccggagtttcgttcacgtttcttacagctttaccatacgcgttatctgcgcccggtacgcgatcatctggtggcgacggtcgagacctacgcgccgctgatggcgcgtgcgccaaagacctttaacttttttattaaccaaccggtggttcgtaatctggcgaaaaaacatatcggtatggtggatttacctctgctttctgccccttcattgcaacagcaactggtgggccatccgtctgccaatatgacgcttgagcaactggagcgcatgagcgccgagcaaaaagcgaaaacggtactggtagttcaggatccgtttaccagctactacgacgctcgggtcgtagcggactttatccgcctggcggaaaaactgggcaggaggccggtattgttaccgttctcgccgaatggtaaggcgcagcatattaaaggttttcttaatcgctttgcgaaaacggcgaaaaaaacctctgagttccttaatcggatcgccgcgttggggatgccaatagtgggcgtcgatccggcgctggtcctgtgttatcgcgacgaatataaactggcgctgggcgaacagcgcggcgattttcatgtgttgctggtgaatgaatggctggcgcaggaaataaatgcaagactgtccgtcgaggtaagcggtgaaccgtggtacttttttggtcattgtacggaagtcacggctttacccggcgcgcctgcgcagtgggccgccatctttgcccattttggcgcgaagctggaaaatgtcagcgtaggctgctgcggtatggcgggcacttatggacatgaactcaccaatcataaaaattcgctgggaatttatgagctatcctggcatcaggcgatgcaacgtctaccgcgaaaccgctgcctggcaaccggctattcctgccgaagccaggttaaacgcattgaaggtacgggcgtgcgtcacccgttgcaggcattactggagattataggttgatctggaaacgtgaagtgaccctcgatgcgcttaatgcgatgggggaagggaatatggttggcctgcttgatatccgctttgagcgtattggggacgatacgctggaagcgacaatgcccgtcgatcatcgcaccaaacagccgttcggcttgctgcatggcggagcgtctgtggtgctggcggaaagtatcggctcggtcgcaggctatctgtgtacgcagggggagcaaaaggtggtggggctggaggtgaatgccaaccatgtacggtcggcgcgtcaggggcgcgtacgaggcgtctgtaaagcgttgcataccggggctcgccatcaggtctggcagatagagatctttgatgaacagggacgtctgtgctgttcttcgcgccttactacggcgattgtgtgacgttgtcaccataaaagtgtgatgcatattgcttttggtcaaaatgtgcgcagaaaaaggtgatatactgtgcacgtttacacataagcgaggatgatatgtctattgatttagacccaacccaactggcgattgaatttttacgccgtgataaaaccgaactttctcccgcgcagtatttgaagcgtttaaaacagctggagttagagtttgccgatctcctcaccctctctgcaaccgaactgaaagaagagatctatttcgcctggcggttgggcgtgcattaatagagtctgtgtaggccggataaggcgttagccgccatccggctatgttaccaggcaatctcaccagacactgtcccccggtaatagataacccccttgattttgtgtaaaaaaaatacagatcgccatttgtgctaaaaaggtgcgctctctttatgagattattcttatgccccttcaagagctaagccattaagagtgccggagataagcgccggatggggccggaacccttaagcctgtattgaacagacttaagggtttttcttttccgggcgcgtaaaaaactaaggtctgtcaataaccgctggcatgtcgtcagccctattattattcaaaatacggttagccagcacacctgacatcatcgatccgttaacgttcagagccgtgcgggccatatcaacgataggttcgatggcaataaaaataccgaccagcgcaacgggaaaattcaacgtcgacaggacaatcagcgccgcgaacgtaccaccgccgccgacgccggctacgccaatagaccctagcgcaatggcaggcaacatcgcggccagaaaatgcagcgagagcggatcgatgccgatggtgggcgcaatcatcgctaccataatagccggataaatcccggcgcagccattttgccccatactggagccaaacgaggcggaaatattggcaatggtgctttgtacgccaaatttttcctgggcggaaatggccagcggaatagaggctgcgctgctgcgggagacaaacgcaaaggttaagacgggccagaccattctgaaataatgcgctggattattaccgctgaggatcagcaagatggcgtgcacgataaacatcatgaaaatcgcgatataacaggcgccgataaaaccaagtaagctggcgaattgttcaaggcggtatgatgaaaatacggtggtcattaatgccatgacgccatagggcgttaatgcaataacgatacgtaccatcttcatgacccagatctggatagcgttaatgcctgcgcttaatttctgaccttcttccggcgcctcttttttgacctttaacagggcgatccccgctattagcgtgaagataacgatgccgataacggaaacacttctggctcccgtaagatcaagaaaaatatttgtcgggatcagcgatgtcactaactggggaatcgacaccgcggcagtcttattgacttcttctgtagttaacattgacggcatgtgcacaaaagcgctggcgtcaagccccagtatatgagcggtcagtaatccgataaaaccggcaaccatcaccaggcataacatgcatccgacgatcgtcagcgacatttttccgatgccggcgctattttccagtttattgatggcggaaagaatagaaataaaaattagcggtatagcgaccagttttaacagatggacgtagccattgccgacgatgctgtaccattcgataatggttttagtgtgatttgctgaaataaaatgcagggataaaccaataacagcccctaaaaagatagcgataaaaacgcttttcgacagggaatcgcttttttgattaattctcaagatggcccacgagaaaaccaaaaaaagtgcgatatacgcgagcgtaacaaccatattttaagcctcttgcctcattcagcacctgaaatgccggaaagagtttacataaacctatagctcaaactgagttatagaaccgcagcggattataaagagcgcaacgccaggtatccatacaaaaaatggggttctgacctcgccgcccggcaatgtcgacagcctattaattaaatagtcattttctatacatcttttcgtttttgacctgccagaacggttaatgtcttataaatcattacttatcaaaaagttaagtggttttttgtctgtcgtatgacctggcggacagggtctatgcttaataaaaggcgctcaatatgaccatttgttggaaagcccctgcggttaaggggttgaagtgataatcattatcactaacatgctgttatatcctggtgatttagaacgcgaggtaactctatggaattgcattcaggcacgtttaacccggaggacttcccctggcaagggctgacgctaacgccagcggcggcagcgcacatacgtgaactggcagcaaagcagccgggcatgttgggcgtgcggttaagcgtaaaacagacgggatgtgccggatttggctatgttctggataccgttcgggagccggataaagacgatctggtttttgaagccgaaggcgcaaagcttttcgcaccgttacaggcgatgccttttattgacggaacagaagtggattacgtacaggaagggctgaaccagttatttaaatttcataaccccaaagcccagaatgaatgtggctgcggcgaaagttttggggtataggcggtactatgtctcgtaatactgaagcaacggaagaggtcggcatctggacaggcggacgccttaattacaaagaaggatttttcacgcaattacccactgatgaactggcaaaaggcatcagcgaagaggtggtgcgtgcgatttccgcaaagcgtaacgaacctgattggatgctggaatttcgcctcaatgcctatagagcctggctggacatggatgaaccgcactggctgaaagcgcattacgataaactgaactatcaggactacagctattactctgcgccatcatgcggaaactgcgacgatagctgcgtttcccagccgggagccgtacagcaaacgggcgcgaatacctttttgagtaaagaggttgaagacgctttcgagcaacttggcgttccggttcgcgaagggaaagaggtcgccgttgatgcgatttttgactcggtctccgtagcgaccacataccgtgaaaaactggcggaacagggcattattttctgttcttttggcgaagcgatacacgatcaccctgacctggtcaggaaatatcttggcaccgtcgtgccggggaacgataacttttttgccgcgctgaatgcggcagtcgcttccgatgggacatttatctatgttcccaaaggcgtgcgttgcccaatggagttatccacctattttcgcattaacgctgagaaaaccggtcagtttgagcgcacgattctggtggcggatgaaggcagctatgtgagttatatcgaaggctgctccgcgcccgtacgcgacagttatcagctccacgccgcggtagtggaagtcatcatccataaagatgctgaagtaaaatattccaccgtacaaaactggttcccgggcgacaacaacacgggcggcattctgaactttgtgaccaagcgggcgttgtgcgaaggggaaaacagcaagatgtcgtggacccagtcggaaaccggttcggcgattacctggaaatacccgagctgcattctgcgcggtgataattctatcggcgagttctattccgttgcgctgaccagtggacatcagcaggctgacaccggcaccaaaatgatccatatcggtaaaaacacgcgctcaaccattatctcaaaaggcatttccgccggccacagccagaacagctaccgtgggctggtaaaaattatgccgacggcaaccaacgcccgaaatttcacccaatgcgactccatgttgattggcgcggactgcggcgcgcatacgttcccgtatgttgaatgccgcaataacagcgcgcagctggagctcgaggcgacgacatcacgcatcggtgaagatcagcttttctattgtctgcaacgcggcatcagcgaagaagacgctatttcgatgatcgtcaacggtttctgcaaagacgttttctcggaactgccgctggagttcgccgttgaagcgcaaaaactgctggcgattagccttgagcacagcgtcggttaatgatgaaggaaaacccatgttaagcattaaagatttacaggtcagtgtggaagaaaaggcgattttgcgtggcctgaatctggatattcgccccggcgaagttcacgccattatggggccgaacggttccgggaaaagcacgctctccgccaccctggcgggacgtgaagattatgaggtcaccggcggctcggttacgttcaaaggtaaagatctgcttgaactgtcgccggaggaacgggcgggcgaagggatttttatggccttccagtacccggtagaaatccccggcgtcagtaaccagtttttcctgcaaaccgcgctgaatgccgtgcgcgcctatcgagggcaggcgtcgttggatcgctttgattttcaggatctgatggaagaaaagatcgcattgctgaaaatgccggaagatttgctgacccgttcggtaaacgtcggtttttccggcggggagaaaaagcgcaatgatattttgcaaatggcggtgctggaaccggaactgtgcattcttgatgagtcggactccggactggatatcgatgcgttgaaaattgtggcggaaggcgtcaacgcgttacgcgacgataaacgcgcttttattatcgtgacccactatcagcgcatactggactacatcaagcctgattacgtccatgtcctctatcaggggcgaattgtccgttccggcgattttactctggtcaaacaactggaggagcagggttatggctggcttaccgaacagcagtaaagcgctacagcaatggcagcatctctttgaagaaaaaggagaaattcgaactgagcaggcaagacaacatttccaacagatgttacgtctgggattgccgacgcgtaaacatgaagactggaaatacacgccgctggagggcttaacccatagccagtttatccagcagtgtgcgactatcagcgccgcccagcgtgatgcgctggcgctgcaaatcgatgccgtgcggctggtgtttgtcgacggacggtttatgccagagctcagtgatagcacgcaaaacagcggatttgacgttagcgtcagagatgagcgccagacgcttgccgcgccggtacatcccgaggtttttctgcatctgacggaaagcctggcgcaatgtgtcacgtatatacaggtacggcgaaatcagcgtccgaccaggccgctactgttaatgcatatcacgcagggcgtggatagcgacgagctgaataccgcgcattatcgccaccatctgacgctggcagaaggcgcggaagcgacggttattgagcattatgtcagccttacagcggcaaaacattttaccggcgcgcgtctgacgatgaacgttgcagacaatgcgcaactgcgtcatatcaaactggcgtttgaaaatgcgtccagctatcactttgcgcataacgatcttctgctggcgacagacgcctcggcgtttagccacagttttctgctgggcgccgcagtactacgtcaccacagcagctcacaactgaatggcgaaaacgcgacgcttcgactgaatagtctggcgatgccagtgaaaaatgaagtctgcgatacgcggacatggctggaacataacaaaggctactgtaacagccgccagttgcacaagaccatcgtcagcgacaaaggacgcgcggtctttaatggcctgattaacgtggcgcaacactccattaaaaccgacggccagatgaccaataataacctattgttggggaaactggctgaagtcgataccaaaccgcaattagagatctatgccgatgacgtgaagtgcagccacggcgcgacgatcgggcgtattgacgatgagcagatgttttatctgcaatcacgcggcatcaggcagcaggaggcgcggcacatgattctttacgcgtttgccgcagagttaacggaagctatccatgatagcgcccttaaacagcaggtgctggcgcgaatcggccagcgactgcccggaggcctggtatgacatttcctgtagaaaaagtacgggcggattttcccatactgcagcgtgaagttaacggcctgccgctggcttacctggacagcgcagccagcgctcaaaaacctaatcaggtgattgatgctgaatctgccttctaccgtcacggctatgctgcggtacatcggggtatccatacgttaagcgcgcaggcgaccgaaagcatggagaatgtgcgtaagcaggcgtcgcggtttattaacgcccgctccgcagaagaactggtgttcgtgcgcggtacgacggagggcattaaccttgtcgccaacagttggggaacggaaaatattcgcgccggggataacattatcatcagcgagatggagcatcacgccaacatcgttccctggcagatgctgtgcgagcgcaaaggcgctgaactgcgcgtgatcccattgcatcctgacggtacgctgcggctggagaccttagctgcgctgttcgatgaccggacccgactgctggccattacccatgtatctaatgtgctggggacggaaaacccactgccggacatgattgcgctggcgcgccagcatggggcgaaagtgctggtggatggcgcccaggccgtgatgcaccatgctgttgacgtccaggcgctggactgcgatttttacgttttctccggccataaactttacgggccgaccggcatcggcattctgtatgttaaagaggcgttgctgcaagaaatgccgccgtgggaagggggcgggtcgatgatctcgaccgtcagcctgacgcagggaacgacatgggcgaaagcgccctggcgttttgaggcgggaacgccgaatactggcggcatcatcggtctcggcgcggcgattgattatgtgacgtcgctgggactggataagattggcgattatgagcagatgctgatgcgctatgcgctggagcaactggcgcaggtgcctgatatcacgctatatggcccggcgcagcggttgggcgtcatcgcgtttaatctgggtaaacaccacgcttacgacgtcggcagctttcttgataattacggtatcgcggtacgaacggggcatcactgcgcaatgccgctcatggcctggtatggcgtgccggcaatgtgccgggcttcgctggcgatgtataacacccatgaagaagtggaccgactggtggcaggattaacgcgtatccaccgcttattgggataacagtgaggttttatggctgcgctaccggataaagaaaaattgctgcgtaactttacgcgttgcgctaattgggaagagaaatatttatatattattgagttggggcagcgcctggcggagttaaatccgcaggatcgcaatccgcaaaatacgattcatggctgtcagagccaggtgtggatcgtgatgcggcgaaacgccaatggcattatcgaattgcagggcgacagcgacgcggcgatcgttaaaggccttatggcggtggtatttattttgtaccaccagatgacggcgcaggatattgtgcattttgatgtccggccatggttcgaaaaaatggcgcttacgcaacacctcacaccttctcgttctcaggggctggaagcaatgattcgcgcaattcgcgctaaggccgccactcttagctaaactatacagacagcgttctacctgatgtcaaatcctttgtcggacggcgacgtcgctttatccagagtggacagagcgtatattttgttgttctgataagcgaagcgctaccagccgtcgcagagggcatcaccaggaatacaggaggtttggtatgaaacgtgcgtctttcattacgctaactattatcggcgcgtatagcgcgttacaggcagcctgggcggttgattatccattaccgccagaaggcagccgtcttattggtcagaatcaaacctataccgtacaggaaggtgataaaaacctgcaggctatcgcccggcgttttgatacggcggcgatgctcatccttgaagcgaacaatacgattgcgccggtgcctaagcccggtacgctaattaccattccctcgcagatgctattgccggatgcgcccagggaaggcgtcatcgtcaacctcgcggagctacggttgtattttacccgccgggagaaaaccgcgttcaggtgtatcccatcggcatcggtttgcagggactggaaactcccgtcatggacacccggatagggcaaaagatccccaacccgacgtggacgccgacggcaggcatacgccaacgttcgcttgagcgggggatcacgctgccgccggtgatccctgccgggccaaataacccgctgggacgctatgcgctgcgtctggcgcacggtaatggggaatatctcattcatggcaccagcgcgccggatagcgtaggtctgcgcgtgagttccggttgcattcgcatgaacgcgccggacatcaaagcgttatttgcgcaggtcagaacggggacgccggtaaaagtgattaaccagccggtgaaattctctgtcgagccgaatggcattcgttatgtagaggtacacaggccgctatcgccggaagaagagcaaaacgtgcagacgatgccctatgtgttgcctgcggaatttaccgcgttcagaaacgcgcaaggggtggatagtcgcctggtcgataaggcgctataccggcgagccgggtatcctgtcagcgtgagcgccggacagacgccagcggtaaatacgaccgcagtcgaatccgctcagaacggttttgtcggggaagaggggcaaacgcgcgcgacgcagtagccttcgcagtaaatgacggacaaaaaaatggcgcacgatgtgcgccattttatatcatgcgtcaaatcatttacagatgcggaatactttgttgtccagacgttggttagcgcgagctgcgtcgtctttagcagcctgaacgtcggaacgcattgcatttacgtcattactcagttgatcaactttagcgctcagcgtctgtacatcggaagacaactgatcgattttagcgttgctggaacaacctgccagtaacgtggaacccagaactactgcacctaagatcagtttgttagtgcggttcataacaataaccttatattttgtgtggttatataggtaaaaaaaatggcgcacgatgtgcgccatttttattacgcaggtactattacttacggtatttagtagcctggttgtccagacgctggttagcgcgagctgcgtcgtctttagcagcctgaacgtcggaacgcattgcgttcacgtcgttgctcagctggtcaactttagcgttcagagtctgaacgtcagaagacagctgatcgattttagcgttgctggagcaaccagccagcagagtagaacccaggattaccgcgcccagtaccagtttagtacgattcattattaataccctctagattgagttaatctccatgtagcgttacaagtattacacaaacttttttatgttgagaatatttttttgatgggaatgcacttatttttgatcgttcgctcaaagaagcatcgaaatgcatgaaagtccctaaaaaaccgaaagaaaacagggggcttccatcggattcttcttagataatccgcaattagatagtaaaatccgatttgatttttttattaatagtggctatcgattaaataaaaaaagcgccggaagggcgcttttttaaacaaattaattcacacaacaattattacagtacgtgaacagaggcggtgttagtggtgccgcttggaaccagcgcgccggagaccatcactacgacgtcgcctttctgggcgaggccgctttgtagggcgacatctttgcccagacggtagaaatcatcagtagaattgatttctttcaccagctgcgataccacgcctttgctcagtactaactgacgggcggtcacttcattggtggtcaatgccaggatggtggcgtccgggaagtatttacgcacggcgcgagcggatttaccgccctgggtcgctaccacgatcagcggcgcttccaatttttcggcggtttctaccgcgccgcggcataccgcttccgtaatgcgcagtttacggctgtcgttgttgtagtccagacggctgttcatgacgcggtcggtacgttcgcagatggtcgccatgatagaaacggcttccagcgggtatttcccttttgcggattcgccggacagcataaccgcatccgtaccgtcgaggatggcgtttgcaacatcgcctgcttctgcgcgggtcggacgcggatttttgatcatagaatccagcatctgagtcgcggtgatcacgactttacgtgcgcggatacatttttcgatcatcattttctgcgcaaagatcacttcttcaaccgggatttctacgcccaggtcgccacgcgcaaccatgatgccgtcggaagcttcgagaatttcatcgaagttgttcaggccttcctggttttcgatcttagagataatctggatgttttcgccgccgtgggctttcagatgctcgcgaatttcgacaacgtcagaacgtttacggataaaggacgcagcaacaaagtcaacgccctgttcgcaaccgaagatcaggtcctgtttgtctttttcagccagcgccggcagagcaatagaaacgcccggcaggttaacgcctttgttctcgcccagatcgccgttgttcagcaccttacaaatgactttattgccttcgatggcggtcacttccataccgatcagaccatcgtcaaccaggacggtgttgccaacgctcaggtcgctggtgaagccttcataggtgacggcaacgatttcattattaccgaccacggatttgtcggtggtaaaagtaaaggtttggcccgctttcagcgaaacgtcgttaccgccttccagtttaatggtgcggatttctggtcctttagtatcaagcagaatagcagcttttttaccagttttgctcatcacgttgcgcaagttctggatacgctgaccgtgttctgcataatcgccatgagagaagttcagacgcatcacgttcatgcccgcgtccagcattttgcttaacatctcttcggattcggttttcggaccgatagtacaaacaattttcgtctttttcatgacagtcttagtctttaagttgaggaggatatggaaatctggcttcgggcgcgcacggcccgtaagctaagcctgtgttgctaaagtgatgatgcctcgctctaaggataggtgacatcgaaagagcgtgcagaggaatgtgtgctcgcgtttcagcccaacgggaaggggataattttagtcgttgagttttacagtccaatgcgctgaaaccattcaagagacaattggcgcgcattatacgctgaaatttacaaaaaaggaaaatgaaaaccctgtttcaaaagacatctgtgcagatccacaacggtttgttattacgctgtttacgatgtcgctggcgatgacgccgcccgaacaggggcggcgttgcgcaacagctggtgttgttgcgcataatgtcaatcgagcaactttttgccttccaggtcgatggcgatgttttggttgtatgcttttcggtagcacagtatcgctatcccgatcgccgcccagctaattccgagtatcagagcgtgaatgttcatgtttaaacagacgtagccgatgacgatcatccccatgatcggcgaaatgacatgggcgaaaatgcgccgctgggctttcatccggaaattgaacaggataaacacacacaggttcacgacaaaaaaagcgaaaagcgcgccaaagttcaccagcgtggagatagattcaatcttgccggaaaacaggtagctgagcagcagggtgacgccgccggtaaacagaatggcataatccggcgttttacgcgtggtatggacgtgagcgaggaaggcgggcaacattcggtcgcgccccattgaaaataacactctggacaccgccgtttgcgcggtaataatgttgccgacggcgcacacaaacgccacaatgatggaaaacgccactttgagccagataccgccaacgttgccggcaatggtgaaaaatgcttcattcgtcgcattaccttccgcgaagcggtcgacgttaccggtggcgaacgccgcaaacgccacaacgataataaacagtaccgtcgccaaaactaacgccaacagtgttgctttactgacggcgcgtcccccgccttcgctttcttcacttaatgtactgatagcgtcaaagccgagaaaattcagcgcagccaccgaaatcgccgttgcgatgagcccaggggtgaaccactgtgaatcgaaaaaaggccggaaggaaagcgttatctgactactgtcctgcatcatcagacggataatgagtagcacgaaaatcgccagaataccgagttgaataaagaccagtaacttatcgaatttcgccgtttgctgtatcccgagatagttgactccggtgccaatagccacataaatcaacggccagacccagaccgggatttgcggtaaaatagcgtggaccgcgacaccgcccagcaccgctacgagcgtagggaacaaaagataatccagcagtaatatccatccggtcagaaaccctacggcgggattaatgcatacgccagcatacgcataggccgaacccgacgaggagatatgctgcgataaggtagagtagctgtacgcggtaaaaaacatcgcgatagcgccaataatataaaccagcgcaaccataccgtgcgaaagattataaacgacgccataaagagagactggtgcgataggcaccataaacaccagaccataaagcactaaatcggtaagagacaattttttgacttttttcatgataaatatcttaatggctttttatgccagatcgcgtaaaaacgcgcttacctctgcgaggcagggcgcgatattttcttcatgcgggttatggctgctgccaggaatagtgaccgcgcggcagtctgaaatgtgagagagcagcggagagacgacgcgctcggttgcctgatcgttttcgccgcgtagtaccagaacaggacagcgtatctggcacaaatggggcgtaatatcccagtcggcaagtttgccatttgccgccagttcattggttccccataaaatgtgataacccgtagggtcggcggcgaactggccagtatcgtcccgcgaagcccggcaggctgtaagcaggcgtgctctgcggcaagcattccgccccaggaatgtcccagtatcgaatacccgtgcccaatacccaggtgatgaattaattgggttaattgacggagataacgcgcaatagtccagaaagacgcgtcggcatgaggaaaatgcgttgaacgaccgcaaccatattgatcgtaaaatattaccatgcgcccgtcatcagccagacggcgataatttaataaataatcaaagccgccagaagggccgccatgaaggataatgagcggcgtgagtaatgattttctgtcgccataaatccgatagcttgtcaatatgttttcagaaaacatttcgccatagagataagtatcattcatattcttaatgactcagtgtgtggcagggcaggcgaaatttatattcgcctgggtaatattatttttttattgtgtgtaaaacattacaccagaaggtggcgtaatgttcccattgcagaaactgcggacttccccagtgcggcgaacaatcactggcaaagcaacatactttccctttatggtaagtacccataactaacagtggatcgccattaatttcagcaaggacctgactattttctttggcgataagcttgttatagcccaacagcggcggccattcgctaaatggctgggtaataacatgttttaccgcagtatttactgctttacatccttgcggtagttctacgcggtcatctacatccagcatatcaaccggcaatacctccgccagaaccgtatttttataattggcttttgcttctattcccgtaaaggataaatacccgccgatcattaacagaccgccgccctcagcaacataatcggcgataagttgtaatgcatcaggaataatgtccatattataaaaggttctgttttgtaacaggaacgtattgctaccgatatcactgatgacgatcgcatcatagcaggctaatgcttcggcggtttgtggaaaacgagtttgcacaatatgggcaggcatgtagtccacatcgatattaccctggcgtaagcaggataataaatagtctgcgccttcttcgtatttgctcgatgtaaagctatcaaaacctttagagtgaatcatatgaatgtgccaggattcgccaataaataagattttcattatgtcacctgttaattaatgtgaatgactttattagattgggtacgcattcgatgtaaaacctgcaagtgctgaggcatactcgacgcaccgacttgttccaccgccagagaagcgaaagcggaggcatattgaatggctgcgaccatatctgcttgtcgcgccagcgcggcggctaaggcgccattaaaagcgtccggcggcatcttttaccacggcgctccacgcaggaatatacaacgtgcgggcgtgctcacagagcagagaaccacgggcgccaagggtaatgatgacttttttcaccccggattgcagaataatatttccggcttttttcgcatcattaatatcagtaatggttacgccggataaaaaagaggcttcagtttcattcggcgtgatgatgtcaatatcagataataaatgcgtcacctgtttcgtatagggggcaggattcagcatgatcattttattttcttgtttgcccaggcgaataaattcagtcaacgcttcaatgttcgtttcgagctgcattaacataacgtcagactcggcgatataacggtgttgctcgttaatctcttgcgtggtgagcatcatattggcgccagggtagatggcgataatattatcgccatccacggcggagacatagatcaatgcgctaccggtgggcgctttatctgtttgatacgcgctgtatgaggtggtgcctgattgaataatatgattcatagcaaatgcgctgaactgatctttgcccactttaaaaataaaatgcgccgcagcaccagcattgtttgccgctaaagcctggttggctcctttaccgccaggatagaatccaaattgactggccagaatggattctccgctttgtggaaaccacggcacggttgctgaaacatcaatattgaatgagcctaaaacacacaccttgcctgctttttttgtgttttcccggtgcagttttgcatcctgatggattggcgtggcgatagtgctggagatatcaatcttattttcagtgataagcttactcagcgcgtcacggtttaaaatccctccgccatagcaacgctgaagcatacctgatttctggaaatagcgtagatcggaacgaatagtctcctggctaaccttataaaggtctgaaagtttactgacgctaacactattatcctttatcagtaaattaatgatggcatgacgtctttcttctttaaacatattgcctccgggtagtgagttgaattgtatttatggcaatattgtcatgcggtgaattcaatcacagattatgcggtcaaccggaagtaatcccaaatgaatgtcaataatcagaagcgcagccaatgtgttaaatattaattgcttacagaaggggaaaatagttttgtgagtgttgtcatatattttctatgtaatatgacggggtgaacgtaaaatagttgggcttgcacgattcagtgagtatatgcagccggacagcattcgcttatcagtcgctaccctcgacgaaataagacgatatcgctctccggccctggggttatatacgctcgatttttgccggcagcccctgacgtaccgccgcgccagaaacccagtcgagccaggtgttggtaatggttcttgtcggatcagcaaagcccagatcgttaagatttatgcctgccctgatttgtggatcatacggcataggcacgccgtccagagagtgctgcgttgcgcccatctcgcggtggccatatccgtgttcgatggcgatgacgcctggcatcacgccatttaacaaactgatttgcgccacgacctgaccgcccggcgtaatgatccgtacccgatcgccatgttgcagtccataacgctcgccgtcttgcggattcagcgccaccaggtttgctggcttcacatggtgtaagcgcgggatgacggctgttgagctggacatggtatttgatttaaatgaaatcagtttcagcggccactgtccaatgggaaactggtcgtcaatcgcacgaccatctgacagacgcgccggataccagaccgggcaaccgctgaagcgctccccggtgatggcgtgacggtgggcggcgacatctgcattccagatctgtaagggttttttccacgcgttacctaaccgttgctccgtatagccgctatcttcgggcgcaaaccggccgccacgcgagtagataaacgccacgcgaccgacctcatcagctttaagcgtgtgctgaattgctggcagaatgcggctgacgccggtaagcgaaatatcttcctgatttgccagcgcgaccggcgtcttgcccataaaggcgatattagcggctacgcgcagatagaagtcttccgcccggttcagtggaaaagtattgccctgcggatcggttatcgcccggtcgccgaagccgggcagatggagccgttttgctaccgcaatacaaaatgcttccattgagacaggttgcccgtccgccgttcggtgagtggcgggggcgacaaccggccagcgggcggtagtggctttactggctacgccgccccagggcgccgtaaagccccagctctcaaaattgtgcgtatccggcacaatgtaatccgccagcgccgtcgtttcattcataaaggcgtcaatcgcgataaagagcggcagtcggcgagggtcttttagcttttcttccgccacggcgcgtagaccgggaacaccgtaaaacgggttgctcatattggaaatccaggctttaagcggataaggatagccttcgagcgcggaggtcaacagttcggtaagctggcctgccacaaagggataccatggcgctttggctggataaggggattgcccgccggcaattttgtcgcggtattcttccgatgctttataagcggttttgctacgggcaatactcaacccggacggtttcacttttccggcaaaactgttcatgttgtagcgggggccgtcgctaacgccgttgaatttgccgccgccgacaaagacgccgccggacaagctgaggttgccgatcagcgcgttaagcatcatgactgaccaggtgttataaaacccattgccggccatcatgccgccgtgactgatgaccgcagctttacgtccgtgactgataaaggtttccgccagcgcgataatttgcgcttccggcacgccgcactgttcgctgtattgcgccaacgagagcttttctgccgcctctttcaggcgttgcaacccgctcttcaccgtgacccgttggccgtcggcgagcgtaacgtactgcgtcacgaaaagccgtgcctgtcggcaagtggacgcatcgaccaactcgccgtcggtattcagcacgacgggggtctcttcgccatcgggcgtaagatggcgcagcgtcaggtgttgtccggcaagcgtcggcagttcatccgcaatgaccaggtgcgtggcgttggtccaactttgctcgccggcctgctgcatcgcctgtacgccgggaatcgccagataatcagcattataacgttgattatccatgatccagcggatcatccccattgccagcgccgaatcgctgccgggcatgaccggttgccagcgaccgcgaggatcggcgagcaccgttgataaggggagggcgggggcgaccacgacgtattgaaaattctcacgcagccgggcgctcgccaactgacgcgcctggcgtttaaagggattaccggactgtgccggggaggtgcccataaagagcgcaaactccacgttttcccagtcgggtttgacatgcgggtttttatccagatcgcccatcaatgccccggagccggcccggtaagccagtccacagtaggcgccatgcgcgccgaaattcttgctgccgaagctatttagcgcaaaacgacgcagaaacgcatcgcggccttcgtcgctggtattcgtgaccagtaactgattggttttgggcccgaaactggggtgctttgcgtcaattggcgtatccggcgcatgaatagcgcgcagtccgtccacatgaccttcgccaaacagatcgccgccttccacgacttcttcaataagctgctcaaagctgatgcgctgccatttcccttcgccgcgtttacccacgcgtttcatcggttcaagcagtcgcagcggactgtacaggctttccagcagcgtggcgccgcgcgcgcaggcggttgagcgggcgtcaagaccgctttctcccgccagttgctccatggcttcgctaaaagggacggacgagtcaatcgggtgttcctgcgacaaggggtgatagggattgccggcgatgcgtattactttgccatcggcatttacccgggcgcggataccgcactgtgtccaacagccgaagcattgcgtcatggcgatggtttgttgtggattttgctgccagtgcgtttgtgcctgcgcctccggaattaacgcgttgccaaagatgcggtcgcgcgttaccttgccggatgtcccgtttaacaggccatcaattgcgcgtttcgccacatcacggtagctcagaccaaaagtgaccatcccaccgacggcgagaccgacttttagccactgacgacgggttaaattagccatgttgtaatctcctggtgagtccgttcagcgtttcacgaatactaatcagtagcgctatccacaggccgaaggtgccgagaatagccagccagccatccgttccgcctggtaacgtgtaagggttaaattgcgcgttgaacttgggtacggtttgtacctgaatcaacaatgtccagcgcatcagccaacatagcgccagcgcgctcagaaccagcaggacgcgtcttagctccgataacggatgacgtagcgccaggctacagaacagcagtgtgaatacccacagcgctagccagccgacagcgtaatatttggctgacagggcgacggtaatccactgacggattgccgtgccggaaagcgtatcgccgctgacccacatggccacaaccagccccagcgccgccagcgtccagagttgtccccacagtatttttggcagccttaccgagtcgcgtcgggcggcgacaatcatcagcgcgaagaacgcctgtaaggcgctaagaaacatcgccacggggaaggcgtagctaaaccagattgggcgcgccagcacaacggagacttcgcggccggtataaatcaacaggcccaccgcgcaaagcgcgctggctaacgccaaccatttagtgacgttgtaacttttattgaataatcgttttatttgctgcgccaggaaccacagagcgagaaatccggtaaacagcggcaggaacaacgctccccagggcatccacgaccagggcgtcggccaggcatagaaatgccagacgcgggcggtctggtgcagatccgccgtcagcgccagcggtgcggtaatcgcacaggtaatggcaatcagtaatgcccgattttcttctgttgcggcgtcttttttccgccagtgaagataacaggcaaacagtgcggcgcaggcggcaatgccaataaaaaagaaatattgtaccgcccacggcagccagctaatgtcctgcgggtgagccagcacttcttcaatgatgagtgaatgcgtcattcagacctcctgccaaagcgcgggctgcgcacggcccattaatggggtgacaaaggcgtcgtccagacccaggtagaaaacatggggcgacgtgccgttttccggctttaataccttgatagcgtcgcgatgttgatgaagcatggtggcgatgcggctatggggatctttgatatcgccaataatacgcgcgccgccgacgcaggactctacgcaagcgggtaacagtccggcttccagacgatggacgcaaaacgtgcatttatcggcagtttgcgtttcatgattgataaatcgggcgtcgtaaggacacgcctggacacaataggcgcagccgacgcagcgtttgttatccaccaccacaatgccgtcttcccgctgaaaggtggcttgtaccgggcagaccggcacacagggggggttatcgcaatggttgcacagacgcggcaacagcacattcgtgacttcctgactaccttcacgctggacctggtattggttcacggtcgtacgaaacgcgccctgcggcgtttggttttcaatagtgcaacttacggtacaggactgacagccgatacaacgccgcaggtcgataagcatggcgtaacggtgtcggggagagccttcatgccgctccggcgaaaaaggaaatttcgcttcagccagcggaaccagcgaggcgccagcggtcaggacgccgagctgctggagaaattgccgtttactgctgtccatattgactcccgtccacattgccaacaatgaaacatttgtcacgatgttggttcatgtgtaatgaataaaaaatgttgatgatttacagtgtaaaaatcgagacggggtgcgctctattgtggttaaccacatacccggcttgttgttgatctaaaacaacataattgacagggatattggggtgagaggtaaaaccgtaaggcgcctggcggtgttggcggcagtagggctactttgtcatggcgcgtgggcagggacgtggaatatcggtattttggccatgcgcggcgaggcgtctacgcgtagccactggcaaccgttggcaaagacattaagccaacagcttccaggcgaaacctttcacatccagccgctggatctgcatcaaatgcaggaggccgttaaccagggaaccgtgcagtttgtgataaccaacccggcgcaatttgtccaactgaacagccatgcgccgctgcgctggttagcttccctgcgttccacgcgcgatgggaaagcggtgagcaatgttattggcagcgtgattttgacccggcgcgatagcggcatcaccacggcgcatgatctcatcggtaagacagtcggcgcgattgatgctcaggcgtttggcggctatttattaggctataaagcgctcagcgacgcgggcttacgcccggagcgcgattttcatcttcgttttaccggatttcctggcgatgccttaatctatatgctgcgcgaaaaagcggtgcaggcggcaattgtgccagtgtgcctgttagaaaatatggatcaggaaggattgattaataaaaaggactttatcgcgctgctttcccgaccgacgcccctgccttgcttaaccagtacgccgttatatcctgactggtcgttcgcggcgctacctgcggtaagcgatgcgctggcggatcgcgtaacgcgagcgctattcaacgcgcccgccgccgcgtcatttcactggggcgcgccagcgtcgaccagtcaggtggaagcgttgctgcgtgatgttcgtcagcaccctcagcagcgtcgactgtggctggatgtcaaaagttggttaatccagcaccagctaatggtcggcggcgtgattttggcgttcctgttgctcacgctcaattatatttgggtcatgctgctggtgcgtcgacgtggaaagcaactggaacgtaatagcgtagttcttcatcagcatgagcgggcgctggaaaccgcccggcaaatgagcgtgttgggtgaaatgacctccgggtttgcccatgagcttaatcagccgctttccgcgattcgacattatgcccaggggtgcctgattcgactgcgcgctgcagatgaacagcatcccttgctgccggcgctggagcagattgaccagcaggcgcaacgcggtgcggatactctgcgtaacctgcgtcactgggtcagccaggcgcagggcaacccggtgctaaccgaagcgtggaaggccatagccattcgcgaggcgattgatcatgtctggcaattgttgcgtatggcgcaacaatttccgacagtgactctgcataccgaggttagcgctgcgctgcgcgtaacgctgccgtcagtgctgctggaacaggtgctggcgaatatcattcttaatgcggctcaggcgggcgccacccatttatgggtcgttgctgaacgcactgaaaacggcatcagtattgttttacaggataacgccgggggaatcgacgaggcgctattacgtcaggcgtttcagccgtttatgaccacccgtaaagaggggatgggcttagggctggcgatttgccagcggctggtgcggtatgggcggggcgatatcagcatcaggaaccagaccgcgccggacggtctgtcgggaacggtggtcacgatacatttcttacatgaacatgggggcagggatggcgacaattcatctactggatgatgatacggcggtcactaacgcgtgcgcgtttttactggaaagtctgggatatgacgtaaaatgctggacgcagggggcggattttttggcgcaggccagtctgtatcaggccggggtcgtattactggatatgcgaatgccggtactggatgggcagggcgttcatgatgcgttgcgccagtgcggaagtaccctggcggttgtttttcttaccgggcatggcgatgtaccgatggccgtggagcagatgaaacgcggcgccgtcgattttctgcaaaaaccggtatcggtaaaaccgctacaggcggcgctggagcgtgcgctgacggtttcatcggcagcggtggcgcgccgtgagattatactgtgttaccagcagttgacgccgaaagagcgtgagctggccagcctggtggcaaaagggtttatgaaccgtgaaattgcggaagcgatgaatatcgcggtgcgtaccgtagaggtgcaccgcgccagagtcatggaaaaaatgcaggccggtagcctggcggaactgattaggcgtttcgaaaaaatggcctcgccagagaccagaatacgaacaacgtatgagccatgaataataaactgcgttatttctttgatttgcatcaaattttgtttaattgagaagactgttatattctgttggtttgagctggcgacgagtaaaacgtatgacaaaaccgacaaaagatgacgaactgtaccgcgagatgtgccgggtggtgggcaaggtcgtgctggaaatgcgcgatctggggcaggagcctaaatatattgttattgcgggcgtgttaagaaccgcgctggcgaatcaacgcatccaacgtagcgcgttagaaaaacaggctatggaaaccgtgattaacgctctggcgcggtcatagccgctatcagggtggcaataacgaaatcgcctttgaattgtcgcgattgtcaccatggcgggctggttacccgccgttagcgatgcgcagggttatcaggtgatggctaagcgcagccctaatgtatcagggtacggctcaaaataattctggctgcgtagatagtcatccggatgttccgccagatagtgcttcagcagcgttaacggtgccaggataggtagtcggcccgcccggtagccgagaatcacctcgcgtaattccgcgcgttgcctgctgttcaacgcgcggtgaaaatagccctggatatgcatcagcacattggtgtgatttttacgtgaagcggggtgtcgcaggatagccatcagtttttctctgtatcggacaaagaaggcatccagatcgtcccactcatgcagacgcgcgacgaaagggccaatttcgcggtagccggcctggtggtgggcgagaagctgaagtttgtatcggctatgaaacgcgagcaaactgtgacgactcaagccctgcgcgcgtagcgcatttaattcatgtagcgcgaagatacgtgcgatgaaattctcgcgtagtaccggatcgtgcaggcgaccatcttcctctatcggcagccagggatatttgtccatcatcgcggcggtaaacagccccgtgccagctttgcggcccctgttacccttttcatcatacaggcgaacgcgctccattccgcaactgggcgatttcgcacacacaataaaccccgccagttcgcctattgttggcagaaaccgatcggcaaaggcattcattcgctcggtgacgtcatcgtgcggggcatggctatagcgcatccgaatgtcgccacaggtcgtctggataagacgcagcgcagggcggggcacgggcaggccgatcgccacctccgggcagatcggtttgtaggccacccacggcgccagagagttcatgacaaaatccatacgcttatgtccgccatcaaagcgtaccgcggcgccagtcagacatccgctaatgccgactacgggtttgttattcatgattcccccttattgaaagtacgacgactgacgccaacggcgcaaaatgttatctcacgctgatttaaaacttacacaactttgtttttttgtctaagttttcgcggagatttttttgatgtacttaaatatcaataagatagaatgaggggaagaaatctatttcagcgcttatagtgtgataacctccagcgaagcgaccacgttgcgccactgggcaagctgttttttctgcccggcagtgagcttgccggtggtcaccaggaaccattttctctgggcgaacagctcgggcgccagaacggctggtggagagggaagcacattgagccgcagctcttgtccggtacgagtcaacgcttccagccagatttcacagtgatccgagagatgccatccgctaataaaagcattgttgccaggcgcttttctgtcgccttcaaggcaaaaagaggtgtaggcaataatgatgccatccaatatttcgcgcagcgtcatcacggcgggaagatgcgcggacactttgctgcgcaacggacgcaataaatgggtcaccagttctgcgcggggatattcccggccacagtcataaatcaactgccgcagcgcgtcaattcgcccttcgtggagatgttgaagcatcgtctcctgaatcgttatccagttatcgcccaggcgaatgaccggacgcgacagtaagggtttgacctgacttatcggtacgccttttctcacccagtcgaggatgctaagcgcttgtcgaatatcgtcatcgctgtataagcgatgcccgccatcagtacgctgcggtttcaataaaccatagcgtcgctgccatgcccttagcgtggcggcattgataccgcatagtctggcaaattcgccgatagaatacgacatggtaaagcccgttaaataaggggattctactatatcatgattaaatgaagactaaggtagtgataaatggtgcggcataccagggcatccgtatggattttgtcgatgatgagcaatactgcgtggcgtaaggctcatcaaaatatgaccaatgcttaataccatcggatgcccctggttaatactctattaacctcattcttcgggcgcagttaagtaactctgtcactttatgaacctgtagctttctcatcatattcatccgatgtgtttcgacggtttttatactgatatgtagcttttcgctgatcccatgattggtatacccctcgtcaataagtttaagaacctgacgctcgcgcaaagtaagcagttgatgattggtcgtgtcagcgtttaattcagccaggatagcttcccgattcaacgtcgggtcaatgtaacgcttgtttactgcgactgtttgcaatgccgctaacaggacttgctgactactgctttttaaaacatagccattagcacctgcggctaaagttttaatggtcatatactcttgttggtatgctgtgtaaaccagaatattcattgctggccaacgctgatgtaattgaggaatgatatccaggccattgatgccaggtaagctaagatcaaggataagtatgtcaggctcgtatgcgcaacaggcattataaacctcaagaccatttttaacatgctctacaattttaaaatgaggccagggtaataaggcattcataatgccgttaatgatgatttcatgatcgtctactaataagatcttatattctttcattttgctgccctcgcgaaaattaagataatattaagtaatggtgtagtttttgaagatcatacgtattttctggcgtaagtcggttagttcttccagcgcgatgattttccccatttttacgcgattctcaatgtctatgacatagcataccaattcagtctgccctatttgacctaaacagccttttaatgtgtgaattaactgatcgattttttttccagccgatacggcattttcaatatcagccagcaagaggtccagtgattggaaaatcttgctattaatgaccatatcatctgtcgccagtagcgctgagcagcgacttggatcctgctcctgtagctctatatttcgtaaaagttggtattctgcggcaatactgatatagcgagctaaggtagccaacgtcactggtttggtaatgtaatgatgaatcccattttttttacaacgatgaatatcttctgtcgctacgctagcggatagcgccacaaacatgcagtcaggatctaaattattcggctcatcgtgccataattgtacacattcaataccatctatttctggcattctaatgtcaatcagtactaaatcgaatcgttgctgttgtgataaagtcagagcctcgttactactggcggcaatagtgacgtgttggcccaggctgacaagcattttgccgatgatatcccgattaatatcggcatcatcaaccaaaagaatctgtaactgccagggtggtaacaaattatttattattggtatatttggtgtacacaatattaactgttgcgccaggtcgtagagttttccggggaaatacaaaagctcagcgttgagaagcgcattttgctggtggggtggttcgccgcgtattccccagcaagccagttggcgatgcaggcagaacggcgctgacagtgtccctttaatttgttgaggcggttggtattcttgtaagggtaatactagcgagacacaggttccaaccccggggacactttttagtgtcagattaccgcccatcattttagccaggcttgacgcaatagtcagtccaattcctgtaccttgcgaatttgtgtctgcttgataaaaagcagtaaagatttgagactgctgctgtatttcaatccctttaccgctatcgctaaccagaaatattaattgttcctcatgacgcttgaccgtcagacgtatccctccggtttcggtaaattttaccgcgttcccgagtaaattaaccaaaatttgccgtaaacggatactgtcggtatgaaaatagagggggacatgttgaccaacaaaagtacgtaatgacagttttttgctttgtgctggcccctggatggtttgcattgcctggtccagtaacggcagtaacgctgtttcttccatatgtaatgtgaaatgaccagactcgatgcgtgaaaaatccagcagattattaataatagctaacaaagacagtgtgcaatttctggcggtatcagctaatccttgctgctctatgtttaaaggggtggtttgtaataattcaattgcaccgagtacgccattcatcggagtacgtaactcatgacttattaccgtaagatgaatgcttttacgtttgttagcttgctcagcgcgtttttttgcttcatttagcgcctgggtgcgctctgcgactttgttttccagattgtcgtattggacttgtagggtatcaagtagttggttaaaagcaccggcaatactatctaattcatccagtcgttgtgctggtaaacgtgtgctcagcggtgcagttgcggttttattaatgatatcgacaaaacgccataacggtttggccagtgagcgatgtagtaaccagcaaaaagccgacgtcatcaacaccaatgctgttaatgtaaaggggatttgttggaggatagtttttaagatgcgattatgtagattaccgtatgggtacagcgtaaccagactccatccggggccatgcaaagttgtgcgtaatatcagaaatccgggaatttgttgccatccatcatgcagcgttacattttctaactgtgtacgtattttttgcgggatgtatgaaaacggcaataagtggttgttttgatccagccatactcgaatactatcatctaatggtaggtggctcttagaaatgagatcaggaagtttaaccatcaccccaaaaaatacgccttgctgatcggcaaccgcaacggaagcgtgccatcctttgccgtttatgtattctggttcactccagtaaaacccggcatgggttgggtataaaggaaagctttttcgcgttaaaagctgtagagttgaataatctgaagggttatcagtagataataacgaaatctcatttttatggttaagaataaaactatcgcgacgaaagcttttttcatcgatatcagaggactgcagaaagagacgatgcttctctccgtttagcgtcggcgtgcaatttgaaggaccgacagaaagatgccggctcacctcagggaaaatatcattatgatgaatctcagtcgctaatgagcattgatacattaaatttttagcgtcacgttcagcctcttcaaatcgttgattgcttagtacaatattcatctcggatagagcggataaatcctctattatatgctgccgtttctgaaccattgatatataagctgcagtaatcacagatagcagccaaataattatggttgttaataaaaataaaaaagttagcctgattactaaagatgtttgcagcgtattcttgagattgagcaaattcataatgctttcctccagttgcctgttgcaaaatctttggcacttgatcactatcgcagtacatatagtttcatcagaagattaatcgatggtgttatcattaggaagataaatttcttcatatataaaccagtcgatgactacaattactttttaataaggcagcgatgtaaaaacatcgtaacagtttatttaataaataatttttcaaattgtaagtttttgtgtctatgctgaaaatgtaattgtgaatttatcggaaaatccgaatgatagaatcgcctgtgacaaggtatatgtagacagcatcctgatattgtacaagaagagtatagtcgaaataaatgtgaatcaggctttttacggatgtggttgtgagcgaatttgatagaaactcccatttatgtctgaggagggattcatgctggcagttttaaaaggcattccattaattcaggatatcagggccgaaggtaatagccgatcctggataatgactattgatgggcatcctgccagaggagaaattttctcagaagcattttctatttctttgttcttaaatgacctggaaagcttacctaagccttgtcttgcctatgtgacactactgcttgcagcacacccggacgtccatgactatgctatacagctcacagcggatgggggatggttaaacggttattataccacaagtagtagctctgagcttattgctattgagatagaaaaacacctggctttaacttgcattttaaaaaatgtaatacgcaatcaccataaactttattcgggtggggtataaaatggtagtaaataaacgtttaatcttaattttactatttatactcaatacagcaaagagtgatgagttatcatggaaaggtaatgacttcaccctttatgccagacaaatgccattagcagaggttttacatctgctctcagagaactatgatacggctattactattagcccattgataacagctacatttagtggaaaaattccgcctggaccaccggtcgatattttgaataacctggcagcacaatatgatttgctaacctggtttgatggcagcatgttatatgtatatcctgcatcgttattaaaacatcaggttatcactttcaatattttatctactggacggttcattcattacttacgcagccagaatatcctttcatcaccgggatgcgaggttaaagaaattaccggtaccagagctgtggaggtgagtggtgttcccagctgtctgactcgtattagtcaattagcttcagtgctggataatgcgttaatcaaacgaaaagacagtgcggtgagtgtaagtatatacacgcttaagtatgccactgcgatggatacccaataccaatatcgcgatcagtccgtcgtggttccaggggtcgtgagtgtattgcgtgagatgagtaaaaccagcgtaccggcgtcatcgacgaccaatggttcacccgctacacaggcattgcccatgtttgctgccgacccacgccagaatgcagtgatcgttcgtgattatgcggccaatatggccgggtatcggaaactcatcacagaattagatcaacgccagcagatgatagagatttcggtgaaaattatcgatgttaatgctggagatattaaccagttaggcatcgactggggaacggcagtgtcgctgggtggcaagaaaattgcgttcaatacaggtttgaatgacggtggtgctagcggtttttcaacggtaatcagcgatacctcaaactttatggtgcgtttgaatgccctggaaaaaagctctcaggcttatgtactttcccagccatctgtggtgactttaaataatatccaggctgtgctggataaaaatattactttctataccaaactgcagggagaaaaagtggctaaacttgaatccatcactacgggttctttgttgcgcgttacacctcgcttgttaaatgacaatggcacgcaaaaaataatgcttaatcttaatattcaggatggacaacaaagtgatacgcaaagcgaaacagatccgctacccgaagtgcaaaattctgaaattgcttcgcaagccacattattggccggacaaagtctattgctgggagggtttaaacaaggtaaacaaatccactcgcaaaacaaaatccctttattgggcgatatccctgtcgtaggtcatttgtttcgcaatgatacgactcaagtacatagtgtaatcaggctttttttgattaaagcctcagtagtaaataatggcatatctcatggttaatccaaagagttcctggaaaatacgttttttaggtcacgttttacaaggccgggaagtatggctgaatgaaggtaacctgtcactgggggagaagggatgcgatatttgtattccgctggctataaatgaaaaaattattctgagagaacaggcagatagtttatttgttgatgccgggaaagccagagttagagttaatggccgcagatttaatccaaataagccgctaccatccagtggggttttgcaggttgcgggagtggctatcgcgtttggtaaacaggattgtgaacttgctgattatcaaatacccgtttccagatcagggtactggtggttggctggcgtattcttgattttcatcggtggaatgggtgtcctgttaagtattagtggtcagcctgaaacggtaaatgacttacctttgcgggttaagtttttattagacaaaagcaatattcattatgtgcgggcgcaatggaaagaagatggaagcctgcagttgtccggttattgctcgtcaagcgaacagatgcaaaaggtgagagcgactctcgaatcatggggggtcatgtatcgggatggtgtaatctgtgatgacttattgatacgagaagtgcaggatgttttgataaaaatgggttacccgcatgctgaagtatccagcgaagggccggggagcgtgttaattcatgatgatatacaaatggatcagcaatggcgtaaggttcaaccattacttgcagatattcccgggttattgcactggcagattagtcattctcatcagtctcagggggatgatattatttctgcgataatagagaacggtttagtggggcttgtcaatgttacgccaatgcggcgctcttttgttatcagtggtgtactggatgaatctcatcaacgcattttgcaagaaacgttagcagcattaaagaaaaaggaccccgctctttctttaatttatcaggatattgcgccttctcatgatgaaagcaagtatctgcctgcgccagtggctggctttgtacagagtcgccatggtaattacttattactgacgaataaagagcgtttacgtgtaggggcattgttacccaatgggggagaaattgtccatctgagtgccgatgtggtaacgattaaacataatgatactttgattaactatccattagattttaagtgagtggaaaatgacaactctgacccggttagaagatttgctgcttcattcgcgtgaagaggccaaaggcataattttacaattaagggctgcccggaaacagttagaagagaacaacggtaggttacaggatccgcagcaatatcagcaaaacaccttattgcttgaagcgatcgagcaggccgaaaatatcatcaacattatttattatcgttaccataacagcgcacttgtagtgagtgagcaagagtaaagtaaaaatatcttagagcctatcccaccaggcgttaattggcgcagccagtttggacacggatagcgcgcaaaaaccggagcgtacacgtagtacgtgaggattttgagcactgcccaggttcaaaatggcaagtaaaatagccctaatgggacaggctcttagttagcacgttaattatctatcgtgtatatggaggggaatgatgataaagaaaaaggctgcgtttagtgaatatcgtgatttagagcaaagttacatgcagctaaatcactgtcttaaaaaatttcaccaaatccgggctaaggtgagtcaacagcttgctgaaagggcagagagccccaaaaagagcagagagacagagagtattcttcataacctatttccacaaggcgttgccggggttaaccaggaggccgagaaggatttaaagaaaatagtaagtttgtttaaacaacttgaagtacgactgaaacaacttaatgctcaagccccggtggagataccgtcaggaaaaacaaaaaggtaaagcataatgtcttcaggaaacatcttatggggaagtcaaaaccctattgtgtttaaaaatagcttcggcgtcagcaacgctgataccgggagccaggatgacttatcccagcaaaatccgtttgccgaagggtatggtgttttgcttattctccttatggttattcaggctatcgcaaataataaatttattgaagtccagaagaacgctgaacgtgccagaaatacccaggaaaagtcaaatgagatggatgaggtgattgctaaagcagccaaaggggatgctaaaaccaaagaggaggtgcctgaggatgtaattaaatacatgcgtgataatggtattctcatcgatggtatgaccattgatgattatatggctaaatatggcgatcatgggaagctggataaaggtggcctacaggcgatcaaagcggctttggataatgacgccaaccggaataccgatcttatgagtcaagggcagataacaattcaaaaaatgtctcaggagcttaacgctgtccttacccaactgacggggcttatcagtaagtggggggaaatttccagtatgatagcgcagaaaacgtattcatgaaaaaagacccgaccctacaacaggcacatgacacgatgcgatttttccggcgtggcggctcgctgcgtatgttgttggatgacgatgttacacagccgcttaatactgtgtatcgctatgccatgcagcttatggaggtaaaagaattcgccggcgcagcgcgactttttcaattgctgacgatatatgatgcctggtcatttgactactggtttcggttaggggaatgctgccaggctcaaaaacattggggggaagcgatatacgcttatggacgcgcggcacaaattaagattgatgcgccgcaggcgccatgggccgcagcggaatgctatctcgcgtgtgataacgtctgttatgcaataaaagcgttaaaagccgtggtgcgtatttgcggcgaggtcagtgaacatcaaatcctccgactacgtgcagaaaagatgttacagcagctttctgacaggagctaaaaatgaatcgaattcacagtaatagcgatagcgccgcaggagtaaccgccttaacacatcatcacttaagcaatgtcagttgcgtttcctcgggttcgctgggaaagcgccagcatcgtgtgaattctacttttggcgatggcaacgccgcgtgtctgctatccgggaaaattagtcttcaggaggcaagcaatgcgttgaagcaactgcttgatgccgtacccggaaatcataagcgtccatcattgcctgactttttgcagaccaatcccgcggttttatcaatgatgatgacgtcattaatactcaacgtctttggtaataacgctcaatcgttatgccaacagcttgagcgggcaactgaggtgcaaaatgcattacgtaataagcaggtaaaggagtatcaggagcagatccagaaagcgatagagcaggaggataaagcgcgtaaagcgggtatttttggcgctatttttgactggattaccggcatatttgaaaccgtgattggcgccttaaaagttgtggaaggttttctgtccggtaatcccgcagaaatggctagcggcgtagcttatatggccgcaggttgtgcaggaatggttaaagccggagccgaaacggcaatgatgtgcggtgctgaccacgatacctgtcaggcgattattgacgtgacaagtaagattcaatttggttgtgaagccgtcgcgctggcactggatgttttccagattggccgtgcttttatggcgacgagaggtttatctggcgcagctgcaaaagtgcttgactccggttttggcgaggaaatggttgagcgtatggttggtgcaggggaagcagaaatagaggcgttggctgaaaagtttggcgaagaagtgagcgaaagtttttccaaacaatttgagccgcttgaacgtgaaatggtttcgccgggcgagatggaagaggagtctgccgaattttctcgtaacgtagaaaaaaatatgacaaaaaatgcgggaaaaagttttacgaaagagggggtgaaagccatggcaaaagaagcggtaaaagaagccctggaaaaatatgcgcaagaaggggaaaagtttctgttaaaaaattttcgtaataaagttctcttcaatatgttcaaaaaaatcctgtatgccttactgagggattgttcatttaaaggcttacaggctatcagatgtgcaaccgagggtgccaatcagatgaatactggcatggttaacacagaaaaagcgaagcttgaaaagaaaatagagcaattaataactcagcaacggtttctggatttcataatgcaacaaacggatgaccaaaaaaagatagaacaaaaacgcttagaggggctttataaaggtagcggtgccgcgcttagaggtgtattagataccattgatcactatagtagcgttcaggcgagaatagctggctggcgcgcttaatctgaggataaaaatatggaagcgagtaacgtagcactggtattaccagcgccttccttgttaacgccttcttccactccatctccctccggggagggaatgggtactgaatcaatgcttctgttatttgatgatatctggatgaagctaatggagcttgccaaaaagctgcgcgatatcatgcgcagctataacgtagaaaaacaacgactgtcctgggaactgcaagtcaatgttttgcagacgcaaatgaaaacaattgatgaagcgtttagagcatcaatgattactgcgggtggcgccatgttgtcgggagtgctgacgataggattaggggctgtaggcggggaaaccggtcttatagcgggtcaagccgtaggacacaccgctgggggagtcatgggcctggggtccggtgtagcgcaacgtcaaagtgatcaagataaagcgattgccgacctgcaacaaaatggggcacaatcttataataaatccctgacggacattatggagaaagcaactgaaattatgcagcaaatcatcggcgtggggtcgtcactggttacggttcttgctgaaatactccgggcattaacgaggtaaatatggtgcaagaaatagagcaatggttgcgtcggcatcaggtgtttactgagcctgcatatttaggggagaccgccatattacttgggcagcagtttatattatcgccttacctggtgatctatcgtattgaggcaaaagaaatgattatttgtgagttcaggcgcctgacgcccgggcaacctcgaccacagcaattgtttcacttactgggacttttacgcgggatatttgtgcatcacccgcagttaacatgtttaaagatgttgataatcaccgacgttctggatgaaaaaaaagctatgctacgcaggaaattattgcgcatcctgacagtaatgggagcgacctttacacagcttgatggcgataactggacaattttatccgccgagcatcttatccagcgacgtttttaaatgaccttcctggcgtaaatcattatcacgtgaaaataacaatcaataggtatgatgatgaaagaagatcagaaaaataaaatacccgaagacattctgaaacagctattatccgttgatccggaaaccgtttatgccagtggttacgcctcatggcaggagggggattattcgcgcgccgtaatcgattttagctggctggtgatggcccagccatggagttggcgtgcccatattgcattggctggcacctggatgatgcttaaagaatacacgacggccattaatttctatggacatgccttgatgctggatgccagccatccagaaccggtttaccaaacgggcgtctgtctcaaaatgatgggggaacccgggttggcgagagaggcttttcaaaccgcaatcaagatgagctatgcggatgcctcatggagtgagattcgccagaatgcgcaaaaaatggttgatactcttattgcttaaataacagaacgaaatatgaaaattcatattccgtcagcggcaagcaatatagtcgatggtaatagtcctccttccggtatacaagcgaaggaggcatcgtttcctccccctgaaattccagcccctggcacccctacagttcctgtggtgcttacgcctgaacaaataaggcagcagagggattatgctatacattttatgcaatacacgattcgtgcgctgggggcgacagtcgtgtttggattatcggttgctgcagcggtaatttctggcggagcaggattacccattgctattcttgcgggggcggcgctcgtgattgctattggggatgcttgctgtgcgtatcataattatcaattgatatgtcagcaaaaggcgccgttacaaaccgccagtgatagcgttgctcttgtggtcagtgcgctggccttaaaatgcggggcaagtcttaactgcgctaacacccttgctaattgtctttctttattaatacgttcaggaatcgctatttctatgttggttttacccctacagtttccactgcccgcggctgaaaatatagcggcctctttggacatggggagtgtaattacctccgttagcctgacggcgataggtgcggtactggattattgccttgcccgcccctctggcgacgatcaggaaaattctgttgatgaacttcatgccgatcccagtgtgttattggcggaacaaatggcattgctctgtcaatctgctactacacctgcattaatggacagttctggtcatacatctcggggagaaccatgaaacctgttagcccaaatgctcaggtcggagggcaacgtcctgttaacgcgcctgaggaatcacctccatgtccctcattgccacatccggaaaccaatatggagagtggtagaattggacctcaacaaggaaaagagcggttattggccggacttgcgaaacgagtgatagagtgttttccaaaagaaatttttagttggcaaacggtcattttgggcggacagattttatgctgttccgctggaatagcattaacagtgctaagtggtggaggcgcaccgctcgtagccctggcaggaattggccttgctattgccatcgcggatgtcgcctgtcttatctaccatcataaacatcatttgcctatggctcacgacagtataggcaatgccgttttttatattgctaattgtttcgccaatcaacgcaaaagtatggcgattgctaaagccgtctccctgggcggtagattagccttaaccgcgacggtagtgacgcattcatactggagtgggagtttgggactacagcctcacttattagagcatcttaatgatcttacctacggactaatgagttttactcgcttcggtatggatgggatggcaatgaccggtatgcaggtcagcagcccattatatcgtttgctggctcaggtgacgccagaacaacgtgcgccggagtaatcgttttcaggtatataccggatgttcattgctttctaaattttgctatgttgccagtatccttacgatgtatttattttaaggaaaagcattatggatattgcacaattagtggatatgctctcccacatggcgcaccaggcaggccaggccattaatgacaaaatgaatggtaatgatttgctcaacccagaatcgatgattaaagcgcaatttgccttacagcagtattctacatttattaattacgaaagttcactgatcaaaatgatcaaggatatgcttagtggaatcattgctaaaatctgaagttattagcgacgatgttcgacggttgctgctggaaatcatgtttgcgggcgttaaccatagcctgatttcccaggtacatgcgatgttaccagcgctaacggttattgttccggataaaaaattacagttggtatgtttggcattattgttggcgggtttaaatgagccgttaaaggccgcgaaaattttatcggatattgatttgccagaggctatggcgctacgaatgttatttcctgcaccaaatgaggggtttgaaaattgaatatttctgatatgagcatagtgcctgtaagcactcaatcttatgtaaagtcctttgcagaaccgagccaggagcaaattaatttttttaaacaattgctgaaagatgaagcatccaccagtaacgccagtgctttattaccgcaggttatgttgaccagacaaatggattatatgcagttaacggtaggcgtcgattatcttgccagaatatcaggcgcagcatcgcaagcgcttaataagctggatagcatgacatgaaggttcatcgtataatatttcttactgtccttacgttctttcttacggcatgtgatgtggatctttatcgctcattgccagaagatgaggcgaatcaaatgctggcattacttatgcagcatcatatcgatgcggaaaaaaaacaggaagaggacggtgttaccttacgtgtcgagcagtcgcagtttattaatgcggttgagctacttagacttaacggttatccgcatcggcagtttacaacggcggataagatgtttccggctaatcagttagtggtatcaccccaggaagaacagcagaagattaattttttaaaagaacaaagaattgaaggaatgctgagtcagatggagggcgtgattaatgcaaaagtgaccattgcgctaccgacttatgatgagggaagtaacgcttctccgagctcagttgccgtatttataaaatattcacctcaggtcaacatggaggcctttcgggtaaaaattaaggatttaatagagatgtcaatccctgggttgcaatacagtaagattagtatcttgatgcagcctgctgaattcagaatggtacctgacgtacccgcgagacaaacattctggattatggacgttatcaacgccaataaagggaaggtggtgaagtggttgatgaaatacccttatcagttgatgttatcgttgacaggactgttattaggagtgggcatcctgatcggctatttttgcctgagacgccgtttttgagccgacctgatcccgaagtgttgcaactttatcgttatttctggcaacctgctcgttacgctgtaccggaatggctggataagctgggctttcatctttcaaactgctggcgttatggcgatcggcccaaattggatcgtcttcttgacagagcgttaaatagactaaggggaagctctgttattccagcctgtttaaatgacaggcaaaaacgacagattcgtcttgcgccgcgtatatcggcatttgcctttggactgggattattcaaactcaggtgtagtgactattttatgctaccagagtatcggcaattgcttctacagtggtttagcgaggatgagatctggcagctatatggttggttggggcaaagagatggcaaattacttcctccgcaagtgatgcaacaaactgcattgcagatcggtaccgccattcttaatcgggaagcgcatgacgatgcggttttacatgcgctattagtattattaccccctccgcagcgtatactttggccgaagacttctcttaccgagattatcttcatggagcatttgctatgagttttacttcacttcctctgacggaaattaaccataagctacccgctcgaaatattattgagtcacagtggataacattacaattaactttatttgcacaagagcaacaagctaagagagtttcacatgctattgtgagctccgcttaccgtaaggctgaaaaaatcatccgagacgcctatcgttatcagcgtgaacagaaagttgagcagcaacaagaaatagcgtggttgcgtaaaaatacgctggaaaaaatggaagtagaatggctggaacaacatgtaaaacatttacaagaagatgaaaatcaatttcgttcattggtcgatcacgccgcgcatcatattaaaaatagtatagaacaggttctgttggcctggttcgaccaacagtcggtagacagtgttatgtgccatcgtctggcacgccaggccacggctatggcggaagagggagcgctttatttgcgtattcatcctgaaaaagaggcattgatgcgtgaaacttttggcaagcggtttacgctgattatcgagcctggtttctctcccgatcaggctgaactttcctcaacacgatatgccgttgagttttcactttctcgtcatttcaacgcgttactgaaatggttacgtaatggtgaagataaaagaggtagcgatgaatattaaaattaatgagataaaaatgacgccccctacagcatttacccctggcctggttatagaggaacaagaggttatttcgccttcaatgttagctctccatgagttacaggaaacggcgggggcagcgctctatgagacgatggaagaaataggaatggcgctgagtggtaaactgcgcgaaagtaataaattcactgatgctgagaaactggagcgcaggcagcaggctttgctgcgtttgataaaacaaatacaggaggataatggggcagcgttgcgtccgcttaccgaagagaatagtgatcctgatttacagaatgcgtatcaaattatcgctcttgcaatggcgcttactgccggcgggttgtcaaaaaagaaaaaacgcgatttgcaatcgcaactggatacgcttacagcggaggagggatgggaacttgccgtttttagtttactggaacttggcgaagtggataccgctacgctgtcctcgctgaagcgttttatgcaacaggcgatagacaacgatgaaatgcccttatcgcagtggttcagacgcgtggcagactggccggatcgcggtgaacgggtccgtattttgctaagagcaatagcctttgaacttagcatatgcatcgaaccctcggagcaaagtcgtttggccgcagcattagtacgcttgcgtcgtttgttgttattccttggccttgaaaaagagtgccagcgtgaggagtggatttgccagttgccgcctaatacattactgccgctactactcgatatcatttgtgagcgctggcttttcagcgattggttgcttgatagacttaccgctatagtttcttcatcgaagatgttcaatcggttactccaacaacttgatgcgcagtttatgctgatacccgataactgttttaacgacgaagatcaacgtgaacaaattctcgaaacgcttcgtgaagtaaagataaatcaggttttattctgatacctggctttcaatatttaggtaaattggctttctggctcatcatgaggcgtcaggatggattgggatctcattactgaacgtaatattcagctttttattcaattagcaggattagctgaacggcctttagcaaccaatatgttctggcggcaaggacaatatgaaacctgtctaaactatcataatggtcgtattcacttatgtcagatactcaagcaaaccttcttagacgaagaactgctttttaaagcgttggctaactggaaacccgcagcgttccagggtattcctcaacgattatttttgttgcgcgatgggcttgcaatgagttgttctccacctctttccagctccgccgagctctggttacgattacatcatcgacaaataaaatttctggagtcgcaatgcgttcatggttaggtgagggaatcagggcgcaacagtggctcagtgtatgcgcgggtcgtcaggatatggttctggcgacggtgttattaatcgctatcgtgatgatgctgttacctttgccgacctggatggttgatatcctgattactatcaaccttatgttttcagtgatcctgcttttaattgttatttatcttagtgaccctctcgatttatcggtatttccgtctttattacttattactacattatatcgtttgtcactcacaatcagcacatcacggctggtactgttacaacataatgccggtaatattgtggatgctttcggtaagtttgtcgtaggaggaaatctcaccgttgggttggtcgtatttaccatcattactattgtgcaatttattgtcattacaaaaggtatcgagagggtggcggaagttagcgcacgtttctcgcttgatgggatgccaggcaaacaaatgagtatcgatggcgatttgcgtgccggagttatcgatgcagaccatgcccgtacattaagacagcacgtccagcaggaaagccgttttctcggtgcgatggacggtgcaatgaaatttgttaaaggcgatacgattgccggtattattgttgttctggtgaacattatcggcggtattattatcgctatcgtacaatatgatatgtcgatgagtgaggctgttcacacttatagcgtactgtcaatcggagatggtttatgtgggcaaattccatcgctgctgatttcccttagcgcgggaattattgtcacccgtgttccgggtgagaaacgccagaacctggcgacagagttgagttctcaaattgccagacaacctcagtcgctcatattaaccgctgtggttttaatgctcctcgctttaattcctggctttccttttatcactctcgctttcttttcagcgttgttagcattgccaattatcctcattcgccgcaaaaagtctgtggtttccgcaaatggcatcgaagcgccggaaaaagatagtatggttcccggcgcatgtcctctaatcttacgtcttaccccgacgttacattctgccgacctgattcgtgatattgatgccatgagatggtttttatttgaggataccggcgtccctctccctgaggtgaatattgaggttttgcctgaacccaccgaaaaattgacggtactgctatatcaggaacccgtgtttagtttatctattcccgcccaggcggattatttattgataggcgcggacgctagtgtggtgggtgacagccagacgttaccgaacggaatggggcagatctgttggctttcaaaagacatggctcataaggcgcaaggttttggactggacgttttcgcgggcagccaacgtatctctgccttattaaaatgtgtcctgcttcggcatatgggagagtttattggtgttcaggaaacgcgttatctaatgaatgcgatggaaaaaaactactctgaactggtgaaagaacttcagcgccagttacccattaataaaatcgctgaaactttgcaacggcttgtatcagagcgggtttctattagagatttacgtcttatttttggcacattaattgactgggcgccacgcgaaaaagatgtcctgatgttgacagaatatgtccgtatcgcgcttcgccgtcatattctgcgtcgtcttaatccggaaggaaaaccgctgccgattttgcggatcggcgaaggtattgaaaacctcgtgcgtgaatccattcgccagacggcaatggggacctatactgcgctgtcgtctcgtcataagacgcagatcctgcaacttattgagcaggcgctgaagcagtcagccaaattattcattgtcacttctgtcgacacccgccgtttcttgcgaaaaattacagaagccaccttgttcgacgtaccgattttgtcatggcaggaattaggagaggagagccttatacaagtggtagaaagtattgaccttagcgaagaggagttggcggacaatgaagaatgaattgatgcaacgtctgaggctgaaatatccgccccccgatggttattgtcgatggggccgaattcaagatgtcagcgcaacgttgttaaatgcgtggttgcctggggtatttatgggagagttgtgctgtataaagcctggagaagaacttgctgaagtcgtggggattaatggcagcaaagctttgctatctccttttacgagtactatcgggcttcactgcgggcagcaagtgatggccttaaggcgacgccatcaggttcccgtgggcgaagcgttattagggcgagtcattgatggttttggtcgtccccttgatggctgcgaactgcccgacgtctgctggaaagactatgatgcaatgcctcctcccgcaatggttcgacagcctatcactcaaccattaatgacggggattcgcgctattgatagcgttgcgacctgtggtgaagggcaacgagtgggtattttttctgctcctggcgtggggaaaagcacgcttctggcgatgctgtgtaatgcgccagacgcagactgcaatgttctggtgttaattggtgaacgtggacgagaagtccgcgagttcatcgattttacactgtctgaagagacccgaaaacgttgtgtcattgttgtcgcaacctctgacagacccgccttagagcgcgtgagggcgctgtttgtggccaccacgatagcagaattttttcgcgataatggaaaacgagtcgtcttgcttgccgactcactgacgcgttatgccagggccgcacgggaaatcgctctggccgccggagagaccgcagtttctggagaatatccgccaggcgtatttagtgcattgccacgacttttagaacgtacaggaatgggggaaaaaggcagtattaccgcattttatacggtcctggtggaaggcgatgatatgaatgagccgttggcggatgaagtccgttcactgcttgacggacatattgtgctatcccggcggcttgcagagagggggcattatcctgccattgacgtgttggcaacgctcagccgcgtttttccagtcgttaccagccatgagcatcgtcaactggcggctatattgcgacggcgcctggcgctttaccaggaggttgaactgttaatacgcattggggaataccagcgaggagttgatactgataccgataaagccattgatacctatccggatatttgcacatttttgcgacaaagtaaggatgaagtatgcggacccgagctactcatagaaaaattacatcaaatactcaccgagtgatcatggaaactttgctggagataatcgcgcggcgtgaaaagcaattacgcagcaaacttaccgtgcttgatcagcagcaacaggcgattattactgaacagcagatttgccagacgcgcgctttagcagtgactaccagactgaaagaattaatgggctggcaaggtacgttatcttgtcatttattgttggataagaaacaacaaatggccggactattcactcaggcgcagagctttttgacgcaacggcagcagttagagaatcagtatcagcagcttgtctccaggcgaagcgaattacagaagaattttaatgcgcttatgaaaaagaaagaaaaaattactatggtattaagcgatgcgtattaccaaagttgagggaagtcttgggttgccatgccagtcttatcaggatgataacgaggcggaggcggaacgtatggactttgaacaactcatgcaccaggcattacccattggtgagaataatcctcctgcagcattgaataagaacgtggttttcacgcaacgttatcgtgttagtggcggttatcttgacggtgtagagtgtgaagtctgtgagtcaggagggctaatccagttaagaatcaatgtccctcatcatgaaatttaccgttcgatgaaagcgctaaagcagtggctggagtctcagttgctgcatatggggtatataatttccctggagatattctatgttaagaatagcgaatgaagagcgtccgtgggtggagatacttccaacacaaggcgctaccattggtgagctgacattgagtatgcaacaatatccagtacagcaagggacattatttaccataaattatcataatgagctgggtagggtgtggattgcagaacaatgctggcagcgctggtgtgaagggctaattggcaccgctaatcgatcggctattgagcctgaattgctatatggaatagctgaatgggggctggcgccgttattgcaagccagtgatgcaaccctctgtcagaacgagccgccaacatcctgcagtaatctaccacatcagctagcgttgcatattaaatggacagttgaagaacatgagttccatagcattatttttacatggccaacgggttttttgcgcaatatagtcggagagctttctgctgagcgtcaacagatttatcctgctcctcctgtggtagtccctgtatatttaggctggtgtcagcttacattaattgaacttgagtctatcgaaatcggcatgggcgttcggattcattgctttggcgacatcagactcggtttttttgctattcaactacctgggggtatttacgcgagggtgttgctgacagaggataacacgatgaaatttgacgaattagtccaggatatcgaaacgctacttgcgtcagggagcccgatgttaaagagtgatggaacgtcttcagtcgaacttgagcagataccacaacaggtgctctttgagattggacgtgcgagtctggaaattggacaattacgacaacttaaaacgggggacgttttgcctgtaggcggatgttttgcgccagaagtgacgataagagtaaatgaccgtattattgggcaaggtgagttgattgcctgtgggaatgaattcatggtacgtattacacgttggtatctttgcaaaaatacagcgtaaacctgataagaaaaataatatgcgaacaatataatagcgttccaggtcgtgtcatgagagatacagtatgtctttacccgattcgcctttgcaactgattggtatattgtttctgctttcaatactgcctctcattatcgtcatgggaacctctttccttaaactggcggtggtattttcgattttacgaaatgctctgggtattcaacaagttcctccaaatatcgcactgtatggcttcgcgcttgtactttccttattcattatggggccgacgctattagctgtaaaagagcgctggcatccggttcaggtcgctggcgctcctttctggacgtctgagtgggacagtaaagcattagcgccttatcgacagtttttgcaaaaaaactctgaagagaaggaagccaattattttcggaatttgataaaacgaacctggcctgaagacataaaaagaaagataaaacctgattctttgctcatattaattccggcatttacggtgagtcagttaacgcaggcatttcggattggattacttatttatcttccctttctggctattgacctgcttatttcaaatatactgctggctatggggatgatgatggtatcgccaatgaccatttcattaccgtttaagctgctaatatttttactggcaggcggttgggatctgacactggcgcaattggtacagagcttttcatgaatgattctgaattgacgcaatttataacgcaacttttatggatcgtcctttttacgtctatgccggtggtgttggtggcatcggtagttggtgtcatcgtaagtcttgtccaggccttgactcaaattcaggaccaaacgctacagttcatgattaaattattagcaattgcaataactttgatggtcagctacccatggcttagcggaatcctgttgaattatacccggcagataatgttacgaattggagagcatggttgaatgacacaacaggtaaatgagtggcttattgcattggctgtggcttttattcgaccattgagcctttctttattacttcctctattaaaaagtggcagtttaggggccgcgcttttacgtaatggcgtgcttatgtcacttacctttcccatattaccaatcatttaccagcagaagattatgatgcatattggtaaagattacagctggttagggttagtcaccggagaggtgattattggttttttaattgggttttgtgcggcggttcccttttgggccgttgatatggcggggtttctgcttgatactttacgtggcgcgacaatgggtacgatattcaattctacaatggaagctgaaacctcactttttggcttgcttttcagccagtttttgtgtgttattttctttataagcggcggcatggagtttatattaaacattctgtatgagtcataccaatatttaccgccagggcgtactttattatttgatcggcaatttttaaaatatatccaggcagagtggagaacgctttatcaattatgcatcagcttctctcttcctgccataatatgtatggtattagccgatctggctttaggtcttttaaatcggtcggcacaacaattgaatgtgtttttcttctcaatgccgctcaaaagtatattagttctactaacgctcctgatctcattcccttatgctcttcatcactatttggttgaaagcgataagttttatatttatctaaaagactggtttccatctgtatgagcgagaaaacagaacagcctacagaaaagaaattacgtgatggccgtaaggaagggcaggttgtcaaaagtattgaaataacatcattatttcagctgattgcgctttatttgtattttcatttctttactgaaaagatgattttgatactgattgagtcaataacgttcacattacaattagtaaataaaccattttcttatgcactaacgcaattgagtcatgctttaatagagtcactgacttctgcactgctgtttctgggcgctggggtaatagttgctactgtgggtagcgtgtttcttcaggtgggggtggttattgccagcaaggccattggttttaaaagcgagcatataaatccggtaagtaattttaagcagatattctctttacatagcgtagtagaattatgtaaatccagcctaaaagttatcatgttatctcttatctttgcctttttcttttattattatgccagtacttttcgggcgctaccgtactgtgggttagcctgtggcgtgcttgtggtttcttctttaataaaatggttatgggtaggggtgatggctttttatatcgtcgttggcatactggactattcttttcaatattataagattagaaaagatctaaaaatgagtaaagatgacgtaaaacaggagcataaagatctggagggcgatcctcaaatgaagacacggcgtcgggaaatgcagagtgaaatacaaagtgggagtttagctcaatctgttaaacaatctgttgcggtagtgcgtaatccaacgcatattgcggtttgtcttggctatcatcccaccgatatgccaataccacgcgtcctggaaaaaggcagtgatgctcaagctaactatattgttaacatcgctgaacgcaactgcatccccgttgttgaaaatgttgagctggcccgctcattattttttgaagtggaacgcggagataaaattcctgaaacgttatttgaacccgttgcagccttgttacgtatggtgatgaagatagattatgcgcattctaccgaaacaccataaatgcttttggtatgcttcttcaggccactgcgaaggttaagagggtaatagcgtatagagcagtgcttgacgataaaggtgagagactgaaaataatcgcttttagcctggcacaagcaccagatagcgtattataaaattaaacaagataatggattggtgcgtctgaatggactcgaaccatcgacccccaccatgtcaaggtggtgctctaaccaactgagctacagacgcattaaaatgatggtgcgttcaattggactcgaaccaacgacccccaccatgtcaaggtggtgctctaaccaactgagctatgaacgcaacgttgtaggtgacaacggggacgaatattagcgtcacaaccgcaatgaggcaagagggaaatcgcaattttcttcctgaaatcacctgattgcggtggaaatatgcaacatgtcgaaaaaatagccgccatgcgacggctatcgtcgtattatcgcgcagcgcgctgcaaaatgatggcggacggctgacgttgtagatagcgcatccgtagcatcattaacaccgccgccgaggtcaggccgatgatgaaccccatccagaagcctgccggtcccatacgatccaccaccaaatccgttaacgccaggatataaccgctgggtaaacctaacacccagtaggcggtaaaggtgataaaaaagatggaacgcgtatctttataaccgcgcagaataccgctgccgataacctgtatagagtcggaaatctggtaaaccgcagcgagcagcattaattgcgcggcaagcgccacgacctcagggttgtcattgtagagcaaagcaatatgcttacgcagagtaacggtaaaaatagcggtaaccacagccatacaaatgccgacgcctaaaccggtacgcgctgcggtttgcgcatccagcgttgagccctggcccagacgataacccactcgaatcgttaccgccgcagccagcgacatcggcagtacgaacatcagcgagctaaagttaagcgcaatctgatgaccggcgacatccacaatacctaatggcgaaaccagcagcgcaacgaccgcaaacaacgtcacttcaaagaacagcgccagcgcaatcggcaaccccagttgaatcaggcgcttcatgacgacgctatcaggtttgccaaagcctttttcattacgaatatcacgcattgaacgcgcgtgtttaatgtaagaaagcatggcgataaacatcacccaatagaccgccgcagtcgcaacgccgcagccgataccgccgagttccggcataccaaaatggccatagataaaaatatagttcaccggaatattcaccagcaggcccaaaaatcccatcaccatacccggtttggttttggccagaccttcgcactggtttcgcgctacctgaaagaaaaggtatcctggcgcgccccacagcagcgcgcgaagataacccacggctttatcggccagcgccggatcaatattatgcatagagcggataatgtatccggcattccacaggacgatcatcaccagcacggagacaaagcccgccagccagaacccttgtcgaacctgatgcgcgatacgctcacgacggccggagccattgagttgcgcaatcacaggcgtcaaggccagcagtaagccgtgaccaaacaaaatggcgggaagccagatagaggtgccgatagcgacggcagccatgtccgtagcgctatagcctcccgccatgacggtatcgacgaatcccattgcggtctgtgccacttgcgcaaggatcaccggtatcgctaacgctaataactgacgcgcttcactggtatacttctgcacgtattcaccttttattttgttgttatatgaaagactaaaaagccgccgtagtggcagccaaaagaaatagcaggggaaatttcagtctattgtagcggggtattactatttctccagtgaaaaaacagttgttaacggcgcattgctggcaagctgtttttccacctgctattgtgctgaacagttctgcgtttatttatttcaggagttgaagatatgtttacggggatcgtacagggtaccgcgaaactggtatcgattgatgaaaaacccaactttcgcacccatgtggtgacgttaccggactacatgctggaggggctggagacgggggcgtcggtagcgcataacggatgctgtttgacggtaactgaaataaacggcaatcagataagctttgatctgatgaaagaaacgttgcgcatcaccaatctgggcgcgttgagggtaggtgatgaggtcaacgtagagcgcgccgccaaattcagcgatgaaatcggtggacatctgatgtcggggcatattattacgacggcggagatcgcgaaaatcctgacctctgaaaataaccatcaggtgtggtttaaagtgcaggatgcgtccctgatgaagtatatcctgtacaagggctttatcggcgtcgacggcatcagtttgaccgtcggcgaggtaacgccaacgcgcttctgcgtgcatctcattccggaaacgctggaacgtactacgcttggcagaaaaaaactgggtgagcgtgtgaatatcgagatcgatccgcaaacgcaggcggttgtcgataccgtagaacgcgtactggctacacgagaaaatgtggtcagaaatcaggccgacattggctaacggaaaataagattcccccgcatgaaatgcgggggagatgattagcgaggaacgcgcagaccgttttcaacgccgcgcgtaaataccacctgccaaagctggatatcacgcgcgcgaaacgcacccgcgcaggcgttgagataatagctgaacatacgtttaaagcgctcgttataattgcccgcaatctctggccaggcattgataaagcgctcatgccacgccatcagagtcgtgtcatagtcggcgccaaagttatgccagtcttccattacaaagtgtgattcgctggcctcggcgatttgacgaacagacggcaagcaaccgttggggaaaatatacttattgatccacggatcgacattatgatcggtttttttagaaccaatagtatggagcaggaaaagaccatccggttttaaattcctgtcaacaacttcaaaataggtgttgtagttttttggcccgacatgttcgaacatgccgacggagacgattcggtcaaactgatcgttaaggtcgcgataatcttccaggagaatggagacatccagaccttcgcaacgcgtctgcgccattttttgttgttcagcggagatcgttacgcccaccacgctaacgccataatgggtcgccatatattgcgacaggccgccccagccgcagccgatatccagcacacgcatccccggttgtagctgtagcttttcgcaaattaatttcagcttggcttgctgtgccgcttccagcgtatcggcatctttccagtaggcgcaagaatattgcatatagggatcgagcatacgggaaaaaaggtcattaccaagatcgtaatgttccttgccgacaatccaggcgcgttttttactttgtagattaatcagacgcgcgccgaggatacggagcgtatctttgacatggtgggggagttgattttcaagaccggcacgtaagactttgctgaagaaaatatccagacgctcgcattcccaccagccatccatgtaactctcacctaaccccaacgatccttcctggaggacgcgtttaaaaaaatcgggattcttaacacgaatgtcagacggggcggaaccattaattgtaatatccgcacgacttaacaattcgttggcgattcggtaccagttatcatccggtacgctgacttcttctatacacgatgaactcatagtttctccatcactggacggtgatcagaaccttaaaacagcgtagacgcttttttggctttgtgagaaatcccacggacaattccgtgagccagttatccgacgtagaacagaggaagggaggagcccttgccgaaaaggccatccatggtgaatcgggaacactccggttcccgttaatgcctaataattatcgtaatataacaaccgggaatcagtataggccgcaatttttgatgattcaaccgaaaattgttagcgtgctaattaccagcggttaacaagtctttagtgagacttgtcgtgggcgacattggcatggggaaatccagtctcagcgcaatctgcatgagactgcattttgtaacctaacgccgccagaacaacggtagagagcattacgctggtggtggtcagcagcggcgtgctgatgagccatgaaaccaccaggcttgccaggaaacataaccccagttgcagcgtattttgtagcgccgcagcgcgccccgtggcttgagggaaagggcgtaacgcttgcgcgacgacgatagggtagattgcgccattagcaatcgccattacgcagaaaggaatcaggatctccaccagtgaggcattattcagaaggcccgctccccaggtggcgataacgctcagcgcatacagccctaacagccacggaagcaattggtagccctgccatttttgtagcgccgcgcggcaaccatatccgccaatcagaaaagcgatggtttgaggaacatagctcaggccaatcactgccgggctgtaacccatcgcgctgagaataaacggggaccctgttagccacgcaaaaaagctggcggaacaggcggcataaatcagcacattaccgcgataggttttagagcgtaacaacgtcgcgaaagtgagtttatcctgtccttcggtacgcgcttttaccgatggttttaagcgcagcgccggcaacatcagcaacaacgtaatcacgaacagggtggcgaaaatcacctgccatgagaaatgcgtcagtatccagcttcccagtaagggcgcaagcgccggggataatcccaccagtggcatgatcgtggcgaagatacggttaattttttgcgaaggataataatcggtcaccagcgcttgccagattaccgttgccgcacaaacgccgacggcctgcacaaagcgcagcgtcagcagtgctgccgcgctttctacccacagcatccccagacttccgagtgcaaagatagataaccccagcagtaaaatcggtttacggccataacgatccgatagcggtccccaaagtagttgcgcgacggcaaagccagctaaaaacaggcttaggctggcgctgacagcggcggcaggcgtttgtaaatccgcctgtatggcggcaaacgcgggcaggtacatgtccgtagccagaaatcccagcacgctaaggccggctaaccagactaaaaaaccttttccaggttgcatatttgtttctctttcttatcagacagacattgtcgcagagtgtagggagtgaaattacggttgtgaaacgttaatatttgtccagtgaattcaaaatttttgtaggcaaattatgtggtcggaatactcgcttgaagtggttgacgccgtggcgcgcaatggcagttttagcgcggcggcgcaagaactgcaccgtgtgccttcagcagtcagttacaccgttcgtcagttagaggagtggctggccgtaccgctttttgtacgacgtcaccgtgatgttgaactaacgcctgctggcgtctggtttttaaaagaagggcgttctgttatcaaaaaaatgcagatcactcgccaacagtgtcagcaaattgctaatggctggcgcgggcagttagctattgcggtggacaatatcgtcagaccagaacgtacccggcagatgatcgtcgatttttatcgtcattttgacgatgtggaactgctggtttttcaggaggtgtttaacggcgtctgggacgcgctctccgacgggcgtgtcgaactggcgattggggcgacgcaggcgattccggtaggggggcgttacgcttttcgggatatggggaccctgagctggagctgcgtagtggcaagcgatcacccgctggcgtcgatgcctgggccgttaagcgatgataccctgcgcaactggccgtcgctggtcagggaagacacttcgcgaaccttaccgaaacggattacctggttgctggataaccaaaaaagggtcgtcgtaccggactgggagtcatcggcaacctgcctgtcggcaggactatgcgtgggaatggtgccgacgcattttgcccgacagtggatagacagcggaaaatgggtggcgctgacgttagagaatccgtttcccgatgcggcctgttgcgtgacgtggcagcaaaacgaggcctcgcccgcgctggcatggctgctggactatttgggcgatagcgaaacgttgaatcgggagtggctgcgggagccagaagaggctcccgacagcggggattaacgccgatagtcgcggaacgggccgtcagcgaccgagcgacgctcaaccaggcgtggatgaacttcaatagactgtgactcttcacgcttattgacgatgcgatccaatagcatattaaatgcggtttcgcctaaagagtctttgggctggtgaatcgtcgtcagcgccggggtaaagaaacgggcgttacgcacattgtcataaccgatcaccgaaacgtcctgcggtacgcgaagccccatttcgtcagctgcgcaaagcgcgcccatcgccataatatcgccgccgcagaaaacggcggtagggcgatgtgactgcgataagatttgctgcatcgcgtggtaaccggattccggctcgaagtcgccctgaacaatccagttgtccggcacgttgatcagcgcctcctccatggctttcataaagcctgccagccgccccgcgcctgtgttgcgctccagcgggccgggaataacgccgatatcccggtggccgcgctcaaccagataacgacccgccatatagccgcctgcaaaggcgttatcaatcaccgtgtcggtaaaatcggccttcgcctcaccccagtccatcaccaccatcggaatatggcgatactcttccagcatggaaagcagaggttctggatactcagaacacatcaccagcaggccatccacgcgcttttgcgccatcatggacaggtaggcgcgctgtttttccaggttattccaggcgttgcctaaaatcagcgtatagcctttctggaaacagtttttttcaactgcctcgataatttcggcaaaataggccgcttcgctgctggtcgccagtaagcctatcgacttggtatggttaaccttcaggctacgcgcgacggcgctgggagagtagtgcagctctttaattgccgcccagaccgcgttacgcgtttcttcagcgacaaaacgcgttttgttgattacgtgtgatacagttgtagtggaaacgtttgcccgtttcgctacatctttaattgttgccattacatttcactccagaccctcgctaagctcctgagaaacgccaggtaaacgtttgcctacacacaccctaatcgcaacatcagggttgcggcacgccggaaaaacgacacggaacgtcaggaaggggtcaatggccgttacgctaattcagtaagcctggaattttgtctgatcttgaggaaaaggggaagcgttaaaaacagttatcaatataaaacatgagagatttttgtgcgggaatgtgcaaaaatgcgctatatcactttttgtgtgggaataaaaaggagaaaacttgatgagtaccgacctgaaattttcgttgattactacgctgattgttctgggcgtgattgtcgcaggtggattaacggccgctctgcactgatttcctctcttctgagagtgggcgtctcctctattctatccctctctaaaacgcagaaggcgtaccttctgcgtactcagacttatgcggcgagatttttcgcaacaaattcccagttaaccagcgcccagaaatgctccagatagtttggacgggcgttgcggtagtcgatgtaatacgcgtgttcccacacatcaaccgtcagcaacggcgttgcatccgtagtcagcggcgtaccggcatttgaggtagaaacgatagccagtttgccatcagcgctttttaccagccatgtccatccggaaccaaagtttttgatagcggcatcggtgaactgcgctttaaattccgcgaagctgccaaaagatgccgcgatagcatcagccagtttcccggtcggttcgccgccagcgtttggcgccaggcagttccagtagaaggtgtggttccacacctgagcggcgttattaaagatgccgccttcggaagtgcgcacgatctcttccagcgatttgccttcaaacgccgtgcctttgatcaaattgttaagattggtcacgtaagtctgatgatgtttgccatagtgatattccagcgtctcagcagaaatatgcggcgccagagcatctttggcatacggtaatgcaggtaattcgaacgacattgcttctctccttattattaatattgcgcacgcacaataaccctggtgcgcgtaaggatagggtagcaaattgagaggtggcgcaaaagaagaagttatcctgtcgttaaacgacaggataaaatattagcgaattgttttaggcgtcatcacccggcgggcgccgacataatgacgctgccagtactcttcgttcagtgaggtgatcttaatttcctgaccgctgcgcggagactggataaacttaccgttgccgacatagacgccaacgtgatcagcggtgccgcgcccctgtgtacggaagaacaccagatcgccgtttttcaactcgctacgctcaatgggggccgcgtcacgcaggtgatacatctcattcgccgttcgggggatacggatcttcactaaatctttataggcataataaaccagaccgctgcaatcaaaaccggtgcgcggcgatgcgcctccccagtgatacggtttaccaatctgattcatgagcttggacatcgcggttttcgtcgccttttgtacttttgcacgatgcgcatcggcaatagagaccggcaatgttcctttccccttcacgcagtgcggcttacggcctttacgcgtcgtgcatttttccgttacgtcgagggcggcgattgacgtgggcgcggttctgttacgacgatgcgtcgtatgacgagattttgtggcggcggtggtacgttttggcgtagaagcggaagaagaacggctggtttttgaggttttttttacgttttttttgctggttttactgatctttttagttgtgcttttctttttatctgccgttttcgtgacatgagaaacagcaggcgtcgctttggcttgcctggaagcatgggccattggcgtaaaggggagagtagtaaaaagtaaagcacagagcgtgatcgagattttgtttatccgcgccactgagcaatcctctgttaaaggcaggcgattcatgcctgcgtatgatttacaaaacctgataattctaatctacaaaagcacagattggtaattgcttttggtttctgaagctatgtttcgttaacagatgtaaaaaaatagcaattaatgctaaacacgaacgcgttatctacaaatcactgcgcggcaacccgcttaaaagatattttgtatacaacttattcccgcagacggtaaaataataaggcatgatgaaaatgttattttccgttgccagcctgacccgttacaatgacaggcttcggtcgtaaaagtagtttaaggaagcgagacaatgagcaccactatcgaaaaaattcagcgccagatcgctgaaaacccgattctcctgtatatgaaaggttcaccgaaactgccaagctgtggtttctctgcgcaagccgttcaggcgctttcagcctgcggggaacgttttgcctatgttgatatcctgcaaaacccggatattcgcgctgaattaccgaaatacgccaactggccgacattcccacaactgtgggtggacggcgagctggtcggcgggtgtgatattgtgattgaaatgtatcagcgtggcgagctgcagcagcttattaaagaaactgcggcaaaatataaaactcaggagccggacgcagagtaatctgtgaaaggggaaagcgacctgtaaaggtcgcttttttaccgccatcgtgagcaagagcggcgttgttagcctcgttatttgtccgtcggcaaaggtaacggccagccgcccaggcgcttccagcgattgacgatttcacaaaacagcaccgctgtccgctcggtatcatacaaagcggaatgggctttttcaccgtcaaactccatacctgccgccaggcacgcttttgataacaccgtttgtcccagcgccagtccgctcaatgccgcagtatcaaaggtgacgaacggatgaaacgggttacgtttcagcgaggcgcgctctgcggcggccatcataaaactgtgatcaaaagtggcgttatgcgcgaccataatggcgcggctacaaccgctgtctttgatacctttacgtaccattttgaaaatagcgtgtagcgcctcatattcactcaccgcgccgcgtagcgggttagagggatcgataccgttaaacgcaagcgcttccggctgtaagttggctccagcgaacggctctacatggaaatgcagcgtcatgtccggcatcaaccagccttgttcatccattttcagcgtgatggcggcgatttcgagcagcgcatcggttttagcgttaaatcctgcagtttcaacgtcgatgacgacaggataaaaaccacgaaaacggtcgcacagaccggaaagttgagcgttatcggacatctgagtctcttaatacgaaaaaatgcagcgcgtattatggcaaattttacgccgggatgcagtaaaacaacgggcgcagtgacctgcgcccggcgggggatcagttacccagaccgcggcctgcgtctttagcttcaatcaattcgattttatagccatccggatcttcaacgaaggcgatgatggtcgaaccgccttttaccggccccgcttcacgggtcacgttgccgccgttctgacgaatgcgttcacaggcttcagcagcattgtcaacgctcagcgcgatgtgcccatacgcattgcccatgtcgtagctctcaacgccccagttataggttagttcgatgaccgcttcttccgtttccggaccatatcccacaaaggccagcgagtatttgtattccggattctcactggtacgcagcaatttcatgcccagaacgttagtgtaaaaagcgatggaacgctgcaaatcgccgacgcgcagcatagtatgcaataaacgcattttcgttgtccttaaaatagtcaagatattcaaagtatagcggcgatgtgaggccgctatcaatgaaattacagagtagggtagtcagtgtagccttccgcgccgccgccataaaaactttcgggacgctgtggattaagttccgctttacgttgcagacgcgccaccagatccgggttagcgatgtaatcgcgaccaaacgccacggcgtcaatcagccctttttcgatcagatcttccgctttttctggcgtataggcgccagcgccgatgatgggaccgtggaaacgcgcgcgcactttttcacggaacgcgtcgctgtacggttcgccgcccgcccagtctggttcagacatatgcagataagcgatgccgcgtttgcctaacgcttcaatcagataaagggcgtcagcttcttcattcgggccgttatcgacattctggaaagtgccgacaggagaaaggcggatgccgatacggtccgcgccccattccttaatgccggcatcaaccacctccagcaccagacgggcgcgattctctacgctgccgccgtaccgatcggtacggtgattagaagacggtgagaggaactggtgcagcagataaccgtgcgcggagtgcagctccaccagatcgaagcctgcctctcgggcattggcgatagcctggcggaaatcgttgacgatcccggggatctcatgagtatccagcgcgcgcggcgtggaagtttctacgcggatggcctggccgttttcgtcacgcaaagaggtgcgggttcccgcattgatagcggatggcgcgacgggcgcttgtccgcctggttgcaggctggcgtgtgaaatacggcccgtatgccacagttgcaccgccatatggccgccctgggcatggactccctgagtgatttttttccaggcggcgatctgctcatcgctgtgtaatcccggtgcgccggcatagcctttcgcctgcgcggagatttgtgtggcttcgctgatgatcaatccggcgctggcgcgttgacggtaatattccgccattaacggcgtaggaatgtcgcccggttcaatactccgcaaacgcgtcaaaggcgccataaatacgcgatttgtcgccgtgatggcacccaccttgaggggggtaaacagttttgctgatgacatagtggctcctgatataagtagaccggtcgtcttgtaataaaggaaataaaaacgcccgttactgctcaggcgttgcaatgatggtcttaacatgcgccaacgcattttccagcggcgcggcgctacgggatattttggcctgcaaattggcgcccagccacagggcataaagtacctgcgcctgtggcaacggctggccggtgaaatgtaaacagtggctattacggccatcttccagcgcgcgtgcaagcagtgccatgatctcctgcgcccctttatccatcgtagagcgcatatcctccgacagatcgcagacttccgctgacagtttcaccgtcaggcaaccgctgatggcgccttgctggcaaaactgctttaacgtttcctgataccaggcgagaagacgatcgcgatgattaccgggaccggaggtgaagtgcgccgtaagacgctgatgatagcaggcgtaatgtcgctcaagcatggcgacgccgaaggcttctttcgagcgaaagtagtgataaaacgaccctttaggtacctgggcggttttgagcaactcgctaagccccatgccggtaaaaccccgttgcatacaaagctgctcgccggtggccagcagatgttcgcgggtatcatgttcggtttgcttattcatgacaggcagtatagtagaccagtcggtctactgcaagcagagttgccataatgtcagttagcgtcttcaatagtcataagcgccaaacgttgaggaggggatgtggccgagcagttggagttttttcctgtagcaagcccatgtcgcggtatctgccagtctgatgagcgtggcttttgtcggggatgtatgcgcagccgcgacgaacggtttaactggcaaaaaatgagcgatgccgagaaacaaaatgtactgcggctttgtcgccagcgtttcttgcgtaaaatacgcgcaaataagcctctcccatcggaagatcctcaacaaccttcactcttttaaacgcggaattgcgtatactcaacctcattattctctatgaggaatctgttatggttcagcgtgtcaccatcgctccacaaggcccggaattttcgcgttttgtcatgggttactggcgtttgatggactggaatatgtccgcgcgtcagttagtgagttttatcgaagaacatctggatttgggcgtcactaccgttgaccatgcggacatttatggcggttatcagtgcgaagcggcgtttggcgaggcgctaacgctggcgccgcatttgcgggaaaaactgcaaatcgttaccaaatgtggtattgcgaccaccgccagagcggaaaataggctcggtcattatattaccgatcgccgccatattattctgagcgccgaacagtcattaaaagatctggcgacagattatctggatatgttgttaattcaccgtcccgatccgttaatggatgcggatgacgtcgccgaggcgtttcaacatctacatcaaagcggcaaagtgcgccattttggcgtttctaattttacgccagcgcaatttacgttgctgcaatcgcgcctgccgttcaccctggcgaccaaccaggtggagatctcgccggttcaccagcctttgttgctggacggcacattagatcaattacagcaactgcgtattcgtccgatggcctggtcatgtcttggcggcggtcgtctgtttaatgatgaggcttatcagccgttgcgccaggaactttccgttatcgcgcaagaactcaacgctagttctattgaacaggtggtctatgcctggattttacgtttgccgtcgcagccgctgccgattattggctcgggtaaaatcgaacgcgtacgcgccgcactagaagcggaaacgctgtcattgtcgcgtcaacagtggttccgaatccgcaaggcggcactgggttatgacgtgccgtaatcgccaactcgttgactttccgttcatgttttcgccagtggtttacacttaacaggcgaccacatgtaacggaggttttatgaagcgattaagtttagcgatggtgacgctgctggcctgtgcgggtgcgcaggctgccagcgagaaagtagagatgaatctggtgacggcgcaaggcgtaggacagtctatcggcaccgtcgtcatcgatgaaaccgaaggcggcttaaaatttaccccacaccttaaagcgttgccgccgggcgagcatggttttcacattcatgccaaaggtagctgccagcccgcgattaaagacggcaaagcggttgccgcagaagccgctggtggtcatctggacccacaaaataccggtaagcatgaaggaccggaaggtcaggggcatctgggcgacctcccggtgttagtcgttaataatgatggtatcgccaccgaaccggttactgcgccgcgtctgaagtctcttgatgaagtgaaagataaagcgctcatgatccatgtgggcggcgataacatgtccgatcagccgaaaccgctcggcggcggcggaacgcgttacgcctgcggcgtcattaaataacccggagacagtgttccctgcgctggagcctgttccagctgcgacagcgaacagtgtaaacgccagataatcgccgccagctcatgcgcggcgggttgatgatgatgtgcgagcgtgtcgcagatacgctgtagttcctgtagcgtgacggcaagcgggcgttgctgcacgtcgcgctcgctcatcacatcgcgcagcagggatatacaaatatcccgcacccgggaaagcggatcggaacgcgactcccaggcgcgcagctgccacaccacatgcgagcagttcagcagcaccactccccaacgtaataaccaccggcgcgccagcgcatcctgactattgctgagctgactgacgtgatgataggtcagcgattcaaactcgctttcgctatgggaagggtgacggctaagctgatcgacgaaatcccggcgtagcgcgcggatatggcggcggctttttacggcatcggaaccggggcgcaaaatcgcaaacgccagccaggaaatcgcgacgccgacgatcttggcggtattatcgttaaggaagtcggcgaagtcgtacaccggtggattggtcacggcgatgaatgagcccataaaaacgataagctgcccccacagtcccgccagcttaggcatctgcagtttaagcagttgcatcgtgacgaacagcggaaaaaggaaaagcaagaattgccacagatcggtgatttgcaccatcaggccaaatttcaccacgaagctgaataaggacagcagcactaaagtacgcatcaataaggaaagcgacttaaacggcgtggcgacgatggagtagaggacgcaactgatcgccgccagggttaatgcgccgggcccggattcccattgcacgccaatactccaggcgccaatcaccgtgagcgtgcaaaaggtacgcacgccgctccagatggcctctgcgttatccgtatgccgcgcaaggccgggagtgcggcggatatggatttgatccaccggcgcgccgctttcgatcagatataattgacggctgctgcgcagatatagctggcaaaaatagcgtaatcgctgccagaacgcgaggtgacgataatcctgttcatcctgcgggcatagcggcgcaataatccgcgccacggtgtagctgtccgcgcgcggttttgccaactcagctaagagttgttcaatgacttcgcggctgttttccggcggcgtcggccagtttaaaagcattctacgcagactggagatcacgctggttagccgtaattgctggtgtaacaatgcatttagcaatgcattctgacggcgaaaacggtagtgactccagaaggcctgaatacgcagcaggttcatggtcaggatttgcccaatgaccccctcatgcgcggagcggatagcgtcggtagtctccggctgccacagtagactggcatgttccagcaagcgcgcatgcatgtttttcaacgcggtgagcagggcagtgccatccgatgtgctgggtaggatcatcatcatcatgccgccacagaggatgccgacgataacttcacatacacgtgcctgggcgatatcccacaactgcgtgatttctacaatattaaccatcgggaacgcgatgatcgccgccgtgtagccggacaactggaaagcataagcggcattattggtaaaatgcgcgcaggcccaggtacaaaaaccgatccaggcggccatgctaaataagaacaaccagggttcattcagcgtatggccggcaataatcaacgcggcggtcgcgccgagtaaactcccggcaatacgccccagacttttactgattacgccgcctacggtcggaaagctcaccactgcggccgaagtcatcgcccagtagggctcatccagattgagataataagcgaatgtcagcgcgagacacatggcaatggtattgcgcaacgcgtaacgccactggccggaggtcgctttaaaccagggcgtatttcgcagggccggcagggagagtttcattaccgctgtccaatggctacgctgcaggtagtgccggagacgagcgtgatatcctgcggcaaagcgtcaaattcgatacgtaccggtacgcgttgcgccagacgtacccacggtacgttgggtttgatatcgggcactaaaccggagtcactttccacgctttggtcgtaaatagcgcgcccgatactgccaacgtgaccctgtaacttaacattgccactatacagtgttattaatgcaggctcaccttcgcggatatggcgtagtttggtttcttcgaaatatcccattacataaaatgaatggctatctaccagggcgaaaagtggcttaccggtgctagcataatcaccggtacgcgtggaaaggttggtcacccagccggataccggcgcttttacttccgtctggctaagctgccactgcgcctgttttaacgttgccagtgcgacatctacgctggcctgcatcgctttaacattcagattggcgctatccagatcttcagcagagatgtagttacgcgataaatgtcgacgtcgatcggcttcattattcgcttttgccagatcggactgcgctttggccaactgtgcctgcgcgttaagttctgcaatatggaagggcgttttatcaatgacaaagagaacgtccccagcgttgacgaactgattatctttgatattgagttgggtaatgctgccagaaacctgtggcgttacgctgacctgttccgcgcggattttaccatcgcgcgtccacggtgactgcatatagtaattccataaccaccacgcggccagaacggcgacgacggcgacaatgagagtagaaaaatattttattgtttttaacgacatatttaccacacgatcagtaaaacgaggcccagacatacgcaaagcgtaaagagggagagatccattaacaggggatgccagatttcatcagagtatatccggtcacgcaggagtcggtgaataaacaaccagataacgaacccaagcgcaaaggctttgaagaatggcggaaagtaaacagatgctcccaacatgagatcttgtaagggcaatcctgtggcgttgagtatacacttcacaagcaatgttcctttgcgtcagacatcgatgctttagttttagccaaaaccgaagctacaggtgccaggtgcgcactatgtctgaaaaaatgtctattggtaagcaaatttagcaatacatttgttttgagaatacaaatactgcacactattctaaaatcagcataataacttagcaagctaattataaggaggtgaaattggaatcgccactaggttctgatctggcacggttggtgcgcatttggcgtgctctgattgaccatcgcctcaagcctctggaattgacgcagacacattgggtcacgttgcacaatattcatcaattgccgcctgaccagtcgcagattcaattggctaaagcgataggcattgagcagccatcgctggtacgcacgttggatcaacttgaagataaggggctaatttcgcggcaaacctgcgccagcgatcgtcgcgctaagcggattaaactgaccgaaaaagcggagccgctgatcgctgagatggaagaggtcattcataaaacgcgcggtgaaattttggctgggatttcttcagaggagattgagcttctgattaaacttgtcgctaaacttgaacacaacattatggaattgcactctcacgattgaggtgcaggggcatacgtgtggccatgtgaccacacgtaaagcctggtttagcgtggagagacagtaacctggctgccgttgctggccagcacgacacgctgacctgccgagaaacgcgtatttccttgtttctgcacaaccataatggtgttgccatcgtctttacgaatttccagttccacaccctgggttttattcattgcgctctggacgccctggcccgctacgccaccagccaccgcgcctgccgcggtcgccagtgaacgacccgtaccgccgccgatagtgttgccgaggaatccgcccaacaccgcgccgccgatagcgccaatcacgttagaatcatcaccgccctgaatttgaaccggacgaacgttaacgatagtaccgtacgttacattctgaacttgtttagcctcggatgcggtataaacatcacccgaaaggctatcattgttaacacacccagctaaggataaccccatcagtgaaacggccagtacacgtttaatcatttacccatctcctgttcttcacgaaacgctatttcagcatccctatagctaaattatatggcatttatgcagttaaggtcatatcttctgccgaaagaatgtaaaaatcataatcagaagttaattaactaatcttaaacgaagtgggaagcaagaaaagataggttattgatatccgtggacggcacggcaaaaaacgtgacgcgggcatcgcattgcaaaatacgttatgccgagtgttaaggcttaacccagcttaataaggaagaggtatgaaatcgggccgttttattggcgttatgtccgggaccagccttgatggtgtggatgttgtactggcggcaattgatgaaaccatggttgcgcaacaggcaagtctcacctggcccattcccgttcatctgaaaaaaggcattctcgatatttgccagggacaaccgcttacgctctcgcaactcggccagctggatacccagttaggccggctttttgcacaggcggttaatgcgctgttagcgcaacaacgtttgcagccgcgggatatcgtcgccattggttgtcatgggcaaacggtctggcatgagccgaccggcgaggccccgcatacgctgcaaattggcgataataatcacatcgtcgcccatacggggattacagtggtcggcgattttcggcggcgggatattgcgctgggcggacaaggcgcgccgctggtgcccgctttccatcacgcgctgttgggacatccgacggaaaaacgtatggtcctgaatatcggcggcatcgccaatttatctctgcttttccccggacaggcggtgcgcgggtacgacacggggccgggtaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcgcccaaaagtacaggacgcgaatatttcaactatggctggttagagcgtcatcttacggctttccctggcgcagacgcgcgcgatgtacaggccacgctggcggagctgacggcggtctccatcgcccaacaggtgctgctcaatggcggctgcgagcggctgatggtctgtggcggcggaagccggaatccgttagtgatggcccgtctggcggcgctgttgcccggtatcgaggtttcgaccaccgataaggcggggatcagcggcgatgatatggaagcgctggcctttgcatggcttgcctggcgaacgctcgcgggcctgccgggaaatttaccttccgtgacgggggctacagaagccagtgttttaggcgctatttacccggctaacccaataactcagagttaactgaatttttcccggaccctatatcggtaaactagcaaggtcaggaaggggcgtttgcccttccagaagcaggagagctttcgggatatgcctatgaaaaagatcgcaataatgtttttacctgtgctgctgaccggctgtagcgtttatcaacaatttgttgaacgtatgcaaacggatacgctggaatatcagtgtgatgagaagccgcttaccgttaaagccaataacccgcgtgaagaggtcagttttgtttatgacaataagctgctgaccctgaagcaaggaatctcggcctcgggcgcgcgttataccgacgggatttatgttttctggtcgtaaggcgagagcgccacggtctataaacgagacagaattgtgcttaataactgtcagttacaaaatccgaagcgttgagattttcagtatgggggcgcacaatagcgccacccactgattatttctgatcaacgccatgtctgataacaaccaattgcagcagatcgcgcatctgcgccgtgaatacacgaaaggcggcttgcgtcgccgcgatttacccgctgaaccgttaaccttatttgagcgctggcttgggcaagcgtgtgacgccagactggccgatccaacggcaatggtcgtggcgaccgtagatgacaaggggcaaccgtaccagcgtatcgtattgctcaaacattatgatgaaaaaggcctggtcttttatactaacctgggaagccgcaaggcgcatcaaattgagcacaatccgcgtatcagtctgttatttccctggcatatgcttgaacgccaggtgatggtgacaggcaaagccgagcgtctctccacacttgaggtggtgaggtatttccacagccgtccgcgcgacagccagatcggcgcatgggtctctaaacaatccagccgcatttccgcgcgcggtatcctcgaaagcaaattcctggagctcaagcagaagtttcaacagggcgaagtgccgttacccagcttctggggtggttttcgcgtgagtatcgaacagatggagttctggcagggcggcgaacatcgtctgcacgatcgctttttataccaacgcgacgacggcgcatggaaaatcgaccgtcttgcgccctaaagatgcaaaaatcttgttttaagcactggtgcggatgaatccgccgttttatgctatgtctctttcgcgtctggcgaaaagtcgtgtaccggcaaaggtgcagtcgttttatacatggagattttgatggcaagcagtaacttgattaaacaattgcaagagcgggggctggtagcccaggtgacggacgaagacgcgttggcagagcgactggcgcaaggcccgatcgcgctctattgcggcttcgatcctaccgctgacagcttgcatttggggcatctggttccattgttatgcctgaaacgcttccagcaggcagggcacaaacctgttgcgctggtaggcggcgcgaccggtctgattggcgacccgagctttaaagccgccgagcgtaaactgaacactgaagagaccgttcaggagtgggtggcgaaaattcgtaaacaggttgccccattcctggactttgattgcggcgaaaactccgccatcgcggccaataactatgactggttcggcagcatgaatgtgctgactttcctgcgcgatatcggtaaacatttttccgttaatcagatgatcaacaaagaagcggtgaagcagcgtctgaaccgtgacgatcagggtatctctttcacggagttctcttataacctgctacaggggtacgacttcgcttgtctgaataaactgcacggcgttgccttacagattggcggttctgaccagtgggggaacatcacttccggtatcgacctgacccgtcgcctgcaccagaatcaggtatttggtttgaccgttccgctgattaccaaagctgacggcacgaaattcggtaaaaccgaaggcggcgctgtctggctggatccgaagaaaaccagtccgtacaaattctaccagttctggattaacaccgcagatgccgatgtttatcgcttcctgaaattcttcacttttatggacattgaggagatcaatgccctggaagaagaagataaaaacagcggtaaagcgccgcgcgcgcagtatgtactggccgagcaggtgacgcgcctggttcatggtgaagaggggctggtcgcggcgaaacggatcactgaatgcctgttcagcggttcactgagcgcgctgagcgaagctgactttgagcagttggcccaggacggcgtaccgatggttgaaatggaaaaaggcgccgacctgatgcaggcgctggtagacgccgaactccagccgtcacgtggtcaggcgcgtaagactatcgcctccaacgctgtcactatcaatggtgaaaaacaatccgatcctgaatacatctttaacgatgaggaccgtctgtttggccgctataccttattacgtcgcggcaaaaagaactattgtctgatttgctggaaataaggcattaagtaacagggagtgagaaatcactcccttatttttgatgttcaggtaaaaaaatgaagaatatcctcgctatccagtcccatgttgttttcggacatgcgggcaacagcgccgccgaatttcccatgcgccgtcttggcgcgaatgtttggccgctgaataccgttcagttttctaaccacacgcaatatggtaaatggaccggctgtgtcatgccgcccagccatctgactgagattgtccaggggattgcggacattggccagttagcgcactgcgacgccgtacttagcggttacctgggatctgccgagcagggagaacacattctcggtattgtgcgccaggttaaagcagcaaatccgcaggcaaaatatttctgcgatcccgtgatggggcatccggaaaagggttgtatcgtggcgcctggcgtcgcagagttccatgtgcgttatgcgctacccgccagcgatattatcgcgcctaacctgattgaactggaaattctcagcaaacatagcgtgaataatgtgaatgacgccgtgcaggtggcgcgagaactgattgctcaggggccagaaattgtactggtaaaacatctcgcccgcgccggttacagttcagaacgctttgaaatgctgctggtgacagcgcaggaagcctggcatattagccgtccgctggtggatttcggctcacgtcagccggttggcgctacagcgagctatccggcaacatgacattaattcagtccttccgctttaagcgctgccgcaacggtcggtctttttgcgacacgctgcatataactttcaatatgcgttgacccgtccatattcagttttacgccataggcccaacgcaatacggtaaacagataagcgtctgcaatggtaaaacgctggccgcaaatccactggtcgtctgaaagcgactcatccacatactgaaatttcttttccagaccggcgcgaacggcgggtttaagtgtttccggcgtgtcagggcggaacagcggggtaaagcctttatgcagttccgttgcaatatagttgagccattccagcgtatgatagcgagcaagactacttaccggcgccagaagctggcggtcgggaacgctgtcggcgaggtactgcataatggcgacgccttcagtcaacagtgtgccgtcatccagcagcagagccggaacctgtcctttagggttgactgccaggtaatcatcaccgttttccaggcgttttttcgcgagatcgacgccatcaagcgtaaagtctttgccaatttcgcgcaggataatatgggaagcaagagagcaggcacccggtttgtagaacagtttcatcggtaactcctttttgctgaggtttaaagtatggtagtgcggggacgagcaaaaaaaaagccgctaacgcacagttagcggcctgaatgttgtttcccggaaaattaaactgtagcggctttagagcctttttcagcggtatcatcgtcctgggtcatacggttcagcttaggcgctgtcagcagcatcaggacggcgataacggcggttgctatgccaatctgcataaatacgcgaccatagacttctagggacatcagtgggtcagtcacgtcgctcggcacagccatcaggttggcgacataaccgccgatgatgttagcgcctgccgttgtcaggaaccagctacccatgatgaagcccatcagacgctgcggaaccaactgtgcgaccattgccaggcccagaccggagatcatcagctcaccgatactttgcaggccgtagcttgcgatcagccagtttacggatacgatgccggcatcgttcgcaaatttggcgcccagcggcagaatcaggaacgcgccggaacacagcaccataccaatggcgaatttcatcggcatcggcagcgtatcgcccatcctgttataaatagcggccagaatcgggctgccggtaatgatccagaatgggttcagcgcctgatactgttccggttcgaacgcgataccgagaatagagtgctcgacgttacgaatggcaaagaagttcagcgacgtcggcatctggctgtacagtacgaagaagataatcgcctgcagcatcaaaataaaggcgacgatcattttacggcgagccgcgccgtgcatggaaaacgcttctttaccgaaaataatgacgatgccaagagcgattacgcccagcaccatacgcgcgatatcctggttgtgcagcagccaggtggcgaccgcaatcagaacgacaatacccacgattgtcagcagcagattacggaagttgatcggttcaaagtcgggtttggaaccgtagcttttcacccagcgctggcagaaagcaaagttaacgacggttatcagcataccgacgacgctaagcgcaaacgcggtgctccagccataacgcgccgccagccacggcgtcgccagcatagagaagaaggagccgatgttgacggacatataatacatcgtaaatgcgccgtcgagacgcggatcgtccttcgcgtaacaggtagacagcagggaagacgggttagctttaaacagaccattacccacagcgatagccgccatgcccatatagacgatgccagcgtcatgaccagaccatgcgaccagcgcataaccgatagccagcaccacggcacccagcataataacgcgtttggtgcccagaattttatcacctaaccaaccgccaatggcgaccaggccgtacaccagcgcactgaaggaagagaaaagggtgatggaatccgcttctgacatacccagttgttttaccaggtagacggccataatgccttgcaggccgtaataaccaaaacgctcccataactctatcgagaagattagatagaacgccttcggttgtttgaaagcgttcaaactgacgctttcagttggttttttgtttgcagtagacacttttacctcttttttacgccccgtattaacagggattgtctggcgcgtgatgagtcagactcatccgtccgattgttatattggaggggaaacggcaggtaatgttcactatctttcctctccagacaagagctttgtaataatctgttacatataactcttctggttgaatcgtccgatgtcagaaatgttatccagcgttaaatttcttcatttgaagaatggcagatttttacactgcaaaaaggccattagtttggataaaaggcgatatcttctgctatttaaggtgaaaagcagtgatataggccattatctgaaaaaatggcagagtaatgttttgtagtgaaaacggggcgtcagtctatccggttgtaaatgtaaccttaggtgtcattaaatttcacatgaagttatcaaagtgatcctgatcacggatagatagaaatttttgcgattaaaaaatgattaacctgacgtggagggaaaacgaaagcacattacatcagaaaaaggacagagactggaatgattgatggctaaaatagatccaggccgaaggtgggagcgcgctggtatgacgggcgcactccgaccatatcaaatatcgactttttctttgtattcgcaaaggtcttcaatgaggcaggagccgcagcggggttttcgggcgatacaggtatagcggccatgcaaaattaaccagtgatggcagtccactttgaactcattcggcaccactttcagtaacttctcttctacctgctcgacatttttacccggcgcgaactgtgttcggttgcatacacgaaatatatgcgtatcaacggcgatggtcggccagccgaaggcggtatttagcaccacgttagcggttttacgccccacgccgggaagcgcttccagcgccgcccgatcctccggcacttcgccattatgcttgtccattaaaatacggcaggtcttaatcacgttttccgctttactgttaaataagccgatggttttgatataggatttcacgccttctacgcccagttccagcatcgcggctggcgtattggcggccgggtaaagtttggcggtcgccttgttcacgctgacgtcggttgcctgcgcggaaagcaacacggcaatcagcaactcaaacggcgacgtgaaattgagttccgttgtggggtgcggattgctgtcgcgcaggcgcgtcagaatttccagcctttttgctttgttcatcagactttccctgtttcaccggccggaacagcggaaggcgcggtttcggcgcggcgtttcttcattttttcatcaataagatattttaccgccagcatgagtcccagaccgataaacgcgcctggcggcagcatcgccagcaggaaaggcgagtcggtgtgaaatatctcgacccgtaatacttttgcccagcctcccagcaggctatccgcgccatcgaaaagcgtaccattcccgaggatctcgcgcagtgagcccagcacgaacatcgcgcctgtcgcgcccatgccgatggaaaaaccgtccaacgcggaaagccacggtccttttttcgcggcaaacgcttcggcgcgaccaacaactatgcagttcgttacaatcagcggaataaaaatccctaaagactgatacagaccgaacgcatacgcattgatcagcatctgtactgcgctgaccaccgaagcaatgatcataacgtaaatcgggatacggatttctgccggcgtccagcgacgtagtgcggacaccgtaaggttggtcagcgttaataccagcgttgtggcgagacccagccccagagcgttggttgccgtagacgtcactgccagtaaagggcacaggccaagtagctgcaccagagcagagttatttttccataacccctgaacaacaatgtcttttatttcgctcatggctattctccacaggcggttaaatgggggagctgagcgggcagtgattcggcgtacagcccggcgcgtttaaccgcattcactacggcgcgcggcgttattgtcgccccggtaaattgatcaaaatcaccgccatcttttttcaccgcccagtgcgtatcattttcaccgctgatggttttaccgctaaagtgggtaatccagtcagacaaacggcgctcaattttatcacctaaccctggcgtctcatgatgttccgtcacgcgcgtccccaggatagtaccgttgaaatctgcgccaacaataagctggatagcgccggaatagccatctggcgcggtggcctcaatgatggccgctacgggtttatcatccttgcgagcgataaaaacacggtgtgtgcctttgccgagggcgggcgcatcgaccagataacagctctcttgcagattattattgtaacgatctggcggcaatacctgatcgaacagggcatgttgttgttgcagcgcttgttcgtggatggttgattttgtcatctgattaatcaccgcggtcaatcccgtagagcctgcggcaaaaagcgccagcgtaataccgtgtttacgaatcgttttcagcatggtttatcctttgcgatgtccatagacgcgggggcgcgtgtagtagtcgatcagaggaaccgtgatattcgccaacaggacagcaaaagcaacgccgtccggatagccgccgaagctacgaatcagccacactaataccccagccagcgcgccgaaaattaaacgtccacggttggtcgtggaggcggtaaccggatccgtcaagataaaaaatgcgcccagcatggtggcgcctgacagcagatgaagctgcggcgaggccagcgtagcgggcgagaaaagccaacctaacgcggcgcatagcgccagcgtgagcagaaaactgaccgggatatgccagcggatggctttttgccacagcaggaatacgccgccgacaagccaggcgaggttaacccactgccagcccacgccagccagcgcaccgctgtatatcgggtactgcatgatttgctcaacggagtgcccggcgcgcaaggacgttttaaacgtatccagcggcgtcgcctggctgataccgtcaataccgatacgtagtagcgtcatatcgccgccgctggcggtatgcccgctaaaaatcatccgtaacgtgtccagtatatcgggcgttgttgcggctatttcataaggcggcaaccagcttgtcatttgcaccggaaaggaaattaatagcaccacgtagccgatcatggccggattaaaggggttttgtcccagcccgccatataactgtttagcgataataatggcgaatccggttcccagcacgaccatccaccagggcgcgagcggagggatgctgaccgccagcaaaagccccgtcaataacgcggaataatcctgcaggtgactggcgaccgattgtttgcgcagtctaaggacaatggcttccgcgacgagcgccgtgatagcagccagaacgatctggaaaagcgttccccaaccaaaaaaccacgtctgcgcggcaatccccggcagagcggcgattaataccagcaacatgattcgcgatgtctggcgctggttatgggtataaggcgagcttgcgattctgaataccatttaatcctcgttaacaacctgctgctgtgctgctttttttgcctgaacgcgagcgatagccgcagcaaccgcggctttacgcgggtcggccggttcgacaggttcgcttacggtctgctgctcctgcttacgggctttggcacgggcgatcgccgcttccaccgcggctttacgcggatcgaccggttcggcgggttcgcttccggcctgctgctcctgtttgcgggctttggcgcgggcgatagccgcttccaccgcggctttacgcgggtcgaccggctcggcaggttcgcttccggcctgctgctcctgcttacgagctttggcgcgggcgatagccgcttccactgcggctttacgcggatcgtcgccggatatcgcgctgtcagccatcggatgagcggcttgtttagcgcgcgcttgcgctttacgcgcttcacgggccgcgatgacggcgctattgtctggcagactacccgcctgaataaccaccggttgcgtggcctgcgcctgtttctcttttacccgcgccagcgcagcggcaatggcatcctgatcttttgccgctggttgtaccgctgcgctcttgtgacgtgcaaggcgggcggctttttcgcgctccagtcttgcctgacgagcctcaaaacgcgctttggcttcggcggcgcgtttttcttcaagcctgatcgcattaatctccgctttttcctgacggaaatattggacgagcggaatattactcgggcagacccaggcgcaggcgccgcattctatacaatcagcaatatggtgagcggtagccttgtcatgctgctgccctttgctgaaccaataaagctgctgcggtaaaaggtcggcagggcaggcgtcagcgcaagcgctgcaacgaatacagcttttctcttcctgaggcgcccccatttcagtcacggatggcgccagcaggcagttggtgatttttacgaccggtacgtcaagccagggaagggtgaatcccatcaacgggccgcccatgatgaccatctggtcagcagaggggcagaacccggcatcgttaagcaaatgacgaacgggagtgccgagccgcgcccagacgttacccggacggcttatcgcttcacccgttaaggtgacgacgcgttctgtgatcggttcgccgtcaaccacggcgcgtttcacggcatatgccgtaccgacgttttgcatcagcacgccaatatcagaggagcgcccgccgtggggaacctgttttcccgtcagtatttgggtgagctgttttgcgccgccggaagggtatttggtcgggataacacgtaatgaaatatcatgagcgtcagccagtacggcgcgcagcatggaaatagcctgcggtttgttatcttcaatgccgattaatacctcacgcggttgcagaatatgcgccaggatgcgaataccttccacaatctgcgcggcgcagtcctgcatcagacgatcgtccgccgtaatgtaaggttcgcactctgcggcattgataataagcgtggtgattttatcgtcgccgccctgcaatttaacgccggtgggaaaccctgcgccgccaagcccggcaacgccatactgatgaatgcgttcaatgagcgcttcacggctgtgggcgcggtaatcagaccagccctcgcgttcaatccagcggtcctcgccgtcggcatcaatgatgacgcttaactccgccagcgccgaaggatgcgccgtcgagtggggcgcaatagcgataaccgtcccggaggtgggcgcgtgtaccggcagcattctcccacgtccacgggtaagcgcctggccgcgtagcacgcgatcgccgacgctaacgcacagctcgccctcagcgccaatgtgctgttttaaagggataacaaagcgcggcgccaaaggcacctggcgcagcggcgtgccgtttgactgggacttcatttcgggcggatgaataccaccgtcgaaatcccagattttatcttttctgaaagcggaaaatagtttaagcatgttgttccacgggaatgatgcgaacgggaatggtgttcaaatcccatttccaactgtcgggcgtctcattcaccggacgtaattcgatgcagtgcgtcggacacggatcgacgcacagattacagccagtacagagatcgctcatgaccgtgtgcatggcgcgcgttgcgccaacgatggcgtcaaccgggcaggcctgaatgcattttgtgcagccaatgcagttattttcatcaataactgccagcatacgtactggcgcggcctgctgttcttcaccatcgcatggttgcggctctacgtttagcaactctgccattttcagcatgacggcttcgccgccgggcgcgcaacgattgattttctcgccctggagacccacggcttcggcgtaggggcgacagccgggatagccgcactgaccacactgactctgcggcaaaatcgcatcgattttttcaacaaccggatcatcttcaaccgcgaatcggcgggaggcataacccagaatggcgccgaacaccagacccagaagggtcagggcgccaacggcaatccagatagtattcattacaacttcaccaaaccactaaagcccataaaggccaaagacattaatcctgcggtaatcaatgctatcgcgttaccacgaaaaggggcgggcacatccgccacggcaaggcgttcgcggatagcggcaaacagaaccatcactaatgaaaaaccgacggcggcggaaaatccgtacagcgccgactgaagaaagtgatgaccgagattaatattcagtaacgctacgcccagaaccgcacagttagtggtaatcagtggtaagaagatgcctaacaagcggtataacgccgggctggttttccgcacaaccatttcggtaaattgcacgaccacagcaatgacgaggataaaggccagcgtccgcagataaatcagatccagcggaataagtatccaggtgtcgataagccaggcgcatatcgacgccagcgtcatgacaaaggtcgtcgcgaggcccatccccatggcggtttccagttttttggatacgcccataaagggacaaaggcccaggaatttgaccagtacaaagttattgaccagtacagttccgacaaagagcagcaggtaatcagtcatgtttcggcctgaaataaaaaagccgcctattatctgtcaaactaccacaggcgacaacaggttaactgtagggttattacggattaacaaacgttgttttaacgcgcgctgaacgtttgagataaggcacaatgagcgccgtcgccaacagtgggaagagtaactgacgcacggcaaaggcatctgagacgggcgaaaaggcaaatgctttaaccgccagtaacaccgacaccagcagccagataatgtaatgctttggcacgcagcgtctgcgcttgaagaatgcgatcgtcaaccacaaggtatagtaccacatggcgatagcggtaataaatgaaatgccccatagcagtaaattaccggtttcctgtccgctaagcgttttgaacgtttgcggtgtggcaagcgccataacgtagagtaataacgccagcgaggcgctcaacaacgcgactaacagccaggctaacgggccaagaagccagcctccaattcgttgtggcggtgttgtagtcatatcttctccggggttacgcgcgttaacggtcatgccgctcattttggggcaaatattataaggtttttgatgttaaacgctactttctttattgcacatagcgccagacggattgcggaacctgacctacatcaaacaggcgtcctccggaaaccagctcggcacggcggtgatctgcagcgcgatacatattaacgatgtccatgtcatcagtaagggtatagttaaggtggtcgaacagtttttccagactttcgagcgaactaattttgcggaattttaatagataatcctgaacagtcatataaagttgatccatattaaatataatgccaacggagtagtcactgataaaaaaataaacaaaattgcaccagtgagaggtcaggggtgcaggtaaaaagggaatattcttaccggtaaagagtcaggcgccacatggcgcctggggcgaaaggttaacgcgctttactacaacaggcaataaacgtcagaccagatagaacatatttcgttttttttgccggtttttgacttttctttgcacgccccggggcgctgcttaccgtaccgcgcgaaaatgcctttacattatctgacgcttacttcttctgaacggaagccgtgggctcaggtggttggtaattgtcaatatggttggcaatacctaaaagaatgactgagataatgagaactatccacccagttaattcaataagacgattcattattgacgacatttgctttgatttatccataaacacagagagtaaatgttactttcctggcgaacggtcggcaagagggaggggaacgatttcagcctctgttctgtaacaagttaatcatttgatgctacgttgatggtcaggacgctattgcggctagtcgcacgatggtgtggaatagcgatatctaaaaccggaggcagtgagatgaatgacaaaatccgcgttgggttaatcggttatggctacgccagtaaaacctttcatgcgcccttaattatgggaacgccagggttagagcttgcggcggtatccagcagcgatgaaacaaaagtgaaagcagactggccggcggtctccgtggtctctgagccccgacatttatttaacgatccgcatatcgacctgatcgtgatcccgacgcccaacgatacccatttcccgctggcgaaagctgcgctggaagccggtaagcatgtggtggttgataaaccctttaccgtgacactgtcacaggcgcgagaattggatgcgcttgcgcggagcactggtcgggtactttccgtcttccacaaccgacgctgggacagcgattttttgacgctgaaggccttgctggcggatggcgtgctcggcgaggtgtccttgtttgaatcccactttgatcgcttccgtccccaggtgcgcgaccgctggcgcgagcaaggcgggccgggaagtggtatctggtacgatctggcgccgcacttgttggatcaggccattcaactttttggcctgccggtcagcatgacggtggatttagcgcaactgcgtccgggcgcgcaatctacagattatttccacgcgattttatcctacccccagcgccgcgtgattttgcacggtacgatgctggccgcggcggaatccgcgcgatacatcgttcatggttcgcgcggtagctatgttaaatatggcctcgatccccaggaagaacggttaaaaaacggcgagcgtttaccgcaggaagactggggatacgacatgcgtgacggcgtattgaccctggttgagggagagacgcgcaaagaagagaactggcttacgttgccgggtaactatccggcatattatgccgccatccgcgatgcgttaaacggtaacggtgaaaatcccgtgccggcaagccaggcgattcaaattatggagttgattgaactgggcatggaatcggcaaaacatcgcgcgacgctgtgtcttgcctgagatgtcgcatttctccgcctgggatagcattaaaccgcaggcggagaagagcgttagtgtcaataaagcaatcttacgccgcggccactttttcgcgtagcgcacgtttttcgctatcgctcagaaaggcgatttccagaccgttaatctgcgcctggcgaatctgttcgcggctcaatcctgccgctggcgcggcgacgtgatattcatggataatatctacgccctgaacagccggatcgtccgtattaagactggcgagaacgccatgctcaaggaaggtttttagtggatgatccgccagcgatgcgacggtactggtctgaatattcgaggtcagacaggattcaataccgatacgctgctgtgcaagaaaatccattaacgcgcgatcttcgacagcttttacgccatgtccgatacgctcggcccccagttcgcgaatcgcctgccagatactttccggccctgcggcttcgccagcgtgaacggtaatatgccagcccgcatcgcgcgcccgattaaagtgcgacaaaaacagactgccgggaaagccaagctcatcaccggctaaatccagcgcggtgattttctctctgtgcgccagcagcgcatcaagctcctgtaaacatgccgcctcgccgaaggtacggctcataatgccaatgagtcgtgcctcgacgccaaacgtgttacagccgtcgcgtacaccgtcgataacggcttcaaccacgcctgcgatcggtaactgatgcgccatcgccatatagccgggcgaaaagcgaagctcgacgtaatgcaggccgttacgtgccgcatcttcaatattttcaaaggccacacggcggcaggcgtcaagcgatgccaggacttttaccccccaatcgagtttagtgagaaagcttactaaatcgggttcggttgaggtgacctggacatgcggaatcagcgtttccagcgtttgggcgggaagggcgatgttgaactgccgaccaagatccagaattgtttgggcgcgaatgttgccatcaaggtggcggtggatgtcagtcaaaggaagcgtaatatcaatcatgggcgcactcaatttttaataaaagtgcgcaccattatactacagattgataatgctctggaaattttgcaaaaacggagtcattacgttgcaacttcgcgagagcgcgggagaaattttgtatcattctctgtaacgcgcccccggtcagctcacgggggttgtctctgttatcgcctctcaggataaagggtcaaccccccgcttgtagacggtatcagcgaacggcgcggtggcaaaatccatatccgagatcgtaaaggggagcagatcggcttcgccaaaacgatcggcgacataatcccactacgtacaccatgtcccgcgtcggtcaacttcctgtgaaaaatcgaacatatcccttccttatgcctgaacggtattcatcaggccaaccatttcatcttttaccgactgaacctgcgggccgataattacctgcaaattatgctgattgagctgtacgatgcctgtcgcgtgattgtccttcaatgcctggacatcgacaaacgacatatctttcactgacaggcgtagggggggatgcagttgtccagactcacgatgttttccgtgccgcctaatgctcacgacgagcaccatgtgcggagtcaaacgatagccgctcgcctggtaacgcaaaagtagaggctgcgcgtcgttcggcgcagaccgggtgcagcgtcgcgacacccggcaaggcgattattgttgaggcagcgccggaacgtccggaacggaaagcgccggcatcccaaataggccgacaaagtcttccaacggcattttttgtccgttgagcgtgatctggccattggcgtactgcaaactggaggcgatagtattatccttcagcgttgtcagtcggaacatctgacccattgcggacagcccctgcacctgctgttttgccagtttttccgcatcatcctgctgatagccttccagttttgctatctgcgtcataaactcgaccgccatgtccatcggaattgccagtttcgcatccagcgatttcacggagcggtcgacttcctgtgccagcgtttgcggttgtgccgttgtggttgccggatctttgaggaacagcgacagattcagcgtggtttcccctttggcgtttttccagctaagcggcgccagggtcagaaccggatcgccttttaacagcacggggagagcgctaaagaacgcttcagtgactttttgctgataaagctcaggattctgcgccacgtccggctgattcagcagcgcctgcgtttgcgcatgatattgctgactaaactggtgccaggcttcgccgtcgatttgaccgactttcagcgttaatttaccgctgcccaaatcctgattctgcactttcaggctgttaagcgagtaatccaactggctgttaatggtttttccgtcgttgacgagatcggacttgccggcaatttccatcccttccagcaccgccatctctttaccctcaatggcgatggacagtttatccagcgttaacttttggtcgcctacacgctcgccaaagcttgccagcttactggtaccgtctgttttcaaattattaaaggtgagttgtaccttctgattatattcgttaacggcatcgaccaggccgctctgcgcttcgcccgacagcgaaaccacattaccgtctttatcggcgttaagctggaactcgccgccgctaaaggcgaccttttcaccggcattctcgtagtttaacggcttgagagagatatcggagcgggtatcgccgccataaccaatgcgggtattgataacaaagggcgcgtcgcctttcgcaatatcaaagaggggttttgccgcatcgttattcaccagagtggtttttaccgacgccatagaagggatcagattgagcgttttgagctgggcgagcgggaaggggccatgtgaaacggactcgtccagcacaatgctttgcccgggcttcaaccaggtattgtctgcgccggcaaccggtttgacaaccagttgcagatggctactgaacacgccgcgctggtagttttgataacttaattcgacaccggcctccggcgcagtacgcttgagctgttcattggcctgagtcaccatttctgcaagatggttctccagctttttccccgtataccaggcgccgcctgtccagacgatgccaagtgcaattactacacctgcagctaccagtgtttttttcatatcaattgtccataaaaatgaaaccaggcggattaaaccgcctggaggagttttacgtctgttataagcttagcaagagttgttaaaaaattcagtacgttgctacagcttgttataaacacgcgctaaacggcccgtgccgctggcgttaaccggagactcatccgcgccgataaaggcagattcacccggcttcagtaccagacgctgttcatctttacgtaacaccgcctcaccctcaacgcagaacagaatcgcggcgctgtgttggccgatgctcgtctcctgaagcgccaggtcgtgcagtgaaaaagcaaaatcgtcaaccggaattgggaagtccagctccgcgccgcttttcaccggggcagtcagcaactcgccggcaggcttaggttcgaacttcacgttcgcgaccagctcagggatgtcgatatattttggcgtaaggccagcgcgcagaacgttatcggagttcgccatgacttccagcgcaacgccctgcagataagcatgaggcgtttcggcaaacaggaacatcgcctcgccgggattcagtttgaccacattcagcaacaaaggagagaaaagcccgctgtcgtcaggataatactctgaaatcacgcggatcgtttgccacggttcgccttgctggctgttaagcgccgctttgagtacggctaacgcgcgggatttttcttcgccttgcatattcaacaggctggcgaaaagctggctcagacgttcagcattcggcgcctgcaaaaagtgggcgatagcggaatgcgcgccggcgacaggttgcagtaaagagacaatgtcagaaaattcgcggaacgcgttcatcgccaggaaaggcgccagggcaaaaaccagctctggtttatggttaggatctttatagttccgctctgcggcatccatggggatacccgccgcattttctttcgcgaaaccgatttcggaattgcgcttattcgggtgcacctgaatagagagcggctgcgcggcgcacagtactttaaacagaaacggcagttcgccgaaacggttggctaccgcttcgcccagcatggcggttttattcttttcgatggcgtcacgcagggagacggtttcgccgttggcggtggtgattcgcgagctgcttttgggatgcgcgcccatccagagttcagccattggctgctgctgcggattggcgatgccataaagttccgttaacgcagttttacttccccaggcatagttttgcactgagttaatgagtttttgcattatcaagccctgtttcaatgtggagatcaatgggaggtattaaaccaagaaacccgcatgaagtaacctccgggcgtaaaaagtcgtacttgtctcagtttttgttaaaaaattgtgtaggatagtgtaactcgctttgagtcgggcaatggaacacctgcccagagaataaccataccgagcggtaagtgagagcacaatgtcaaacaaacccttcttttatcaagacccttttcccctcaaaaaggacgataccgagtactacttgttgaccagcgaacatgtttccgtcgccgagttcgaaggacaagagatcctgaaagtcgcgccggaagcgctaacgttgttggcgcgtcaggccttccacgatgcgtcttttatgctacgtcccgcgcatcagcagcaggtggcggatattctgcgcgatccgcaggccagtgaaaacgacaaatatgtcgcgctgcaattcctgcgaaactccgatatcgcggccaagggcgtgttgcccacctgccaggataccggtacggccattattgtcggcaaaaaaggccaacgcgtctggactggtggaggtgatgaagcggcgctggctcgcggcgtatataacacctatatcgaagataacctgcgctattcgcagaacgcgccgctggatatgtacaaagaggtcaataccggtactaacctgccggcgcagatcgatctctacagcgtcgatggcgatgaatataaattcctctgtatcgctaaaggcggcggttcggcgaataaaacctacctctatcaggagacaaaagcgctactgacgccgggtaagctcaaaaattatctcgtcgataagatgcgtacgctgggcaccgccgcctgtccgccgtatcacattgcgtttgtcattggcggtacctcggcggaagcgaacctgaagaccgttaagctggcctcggcaaaatactatgatgcgctaccgaccgaaggcaatgaacacgggcaggccttccgcgatattgagctggaaaaagaattgttgcttgaggcgcaaaatcttggcttaggcgcgcagttcggcggcaaatatttcgctcacgatattcgtgtcatccgattgccgcgccatggggcatcgtgtccggtaggtatgggcgtgtcctgctccgcggatcgaaacattaaagcgaagatcaaccgggaagggttctggatcgagaagctggagcgcaatcccggtaaatatattccagaggcgctgcgccaggcgggagagggcgaggcggtgcgcgttgatcttaaccgtcccatgagcgagatactgcaacaactgtcgcagtatccggtatcaacgcgcttgtcgctgaacggcacgattattgtgggccgcgatatcgcgcacgctaaactgaaagaacggatggacagaggcgaaggtttgccgcagtacatcaaagatcatcctatctattatgcggggccggcaaaaacgccggaagggtacgcctccgggtcgcttgggccgactaccgcaggacggatggactcttatgttgatcagctccagtcgcagggcggcagtatgatcatgctggcgaaaggcaaccgcagccagcaggtgaccgatgcctgtaagaaacatggcggcttctacctgggcagtatcggcggcccggcagccgttctggcgcagggcagtatcaagcgcctggagtgtgtggaatatcctgaactgggtatggaggctatctggaaaattgaagtggaggattttccggcctttattctggtggatgataaaggtaacgatttcttccagcagattcagtcatcgcagtgcgcgcgctgcgttaagtaatgtcgccgccctgcggggcggtaacatgattcgctattttgccggagaacggcgcaagcgccttatccggtctacaccgttgtgttgttatcgttaatactcataagaccgcaaacatgtgagcaatgtcgacacatgatctcatcaacttgagtaaggagcaggtaatggtaacggtacgccgcgagaaagattcaatgggcgtgattgaagtcccggcagataaactgtggggggcgcaaacgcaacgttcgctggagcattttcggatttccacggagaaaatgcccgtctcgctcattcacgctctggcgttgaccaagcgcgccgctgcgaaggtcaaccaggacttagggttgttggcggcggaaaaagccagcgcgattatcgaggcagctgatgaagtgctggcgggaaaacatgctgatgagtttccgctggcgatttggcagaccgggtccggtacgcaaagcaacatgaatatgaatgaagtgttagcgaaccgcgccagtgaaattttgggcggcgttcgcggtatggaacgcaaagtgcatcccaatgatgacgtcaataagagtcaaagctcaaacgatgtgttcccaaccgccatgcacgtggcggcgttactggcgttacgcgaacaccttatcccgcaattatccgcattaacggatacgcttcgcgataaatcccacgctttcgccgatattgtcaaaattgggcgtactcacctgcaggacgcgacgccgctcaccttaggccaggagatttccggttgggtagccatgctggaacataacctcagacacattgagcacagtttaccgcacgtcgcggaactggcgctcggcggaaccgcagtagggacagggcttaatacccacccggaatatgcccggcgcgtggccgaggaactggcgaccattaccgcggcgccgtttgttaccgccccgaataaattcgaagcgctggcgacctgtgacgcgttggtacaggcgcatggcgcattaaaaggactggcggcctcgctgatgaaaatcgccaacgatgttcgctggctggcatccggcccgcgctgcggcattggcgagattgctatcccggagaatgagccaggcagttccattatgcctggtaaagtgaacccgacccagtgtgaagcggtaacgatgctatgttgccaggtaatgggtaacgatgtggccatcaatatggggggcgcatcgggcaactttgagctcaacgtctatcgtccgatggttattcataattttctgcaaacggtgcgcctgctggccgatggcatggcgagtttcaatcaacactgtgcgtcaggaatcgagccaaaccgcgagcgtattacgcagttgctgaatgagtcgctgatgctggtcactgcgctcaatacgcacatcggttacgataaagcggcggagattgcgaagaaggcgcataaagaagggctgacgctcaaagcctcagccgtggcattaggataccttagcgacgcggagttcgacgcctgggtacgtccggagttaatggttggcagtatgacgccgggacgttaatccgccacatacaggtgcagtcgcggaataatcagtcgcagcggctgcgcctgtggtttaaaacggtgctgaatattatcggcgtcatagttttccagcccgccaatatccggcacgccagcgccgttgtccgtgttgattaatgcgataatcggcgaggggcaggcgtgttgcacctgtttctgctggcctttataccagatgcgggcgatcggctgtaccttaaccgggcgcttaatcttgagtttggcctgctgcggtaaggcagcgatatcctgatattcccgttccagcttgaattgccattgttcgcgcgtccacggcgggacgctgcgcggcgacgcgaggctttttttcaactggctcagaacctcatcccggcttaaatttttaataatatgtttatttgcccaaccgaaacgtatggtggcggggttattgataagcgtcagcgtgcggtaagcgttcagcgtaattaagccgggtagatgccgatgcacccactcaaaacgtgccgctgagggaagaccggactctaccgtaaccatctgctcgaaggtggttttcaactggttaatgcgctgtacctgattttccagatctaactgtgtcgcattatccacttgatagcataaaacgccaggcaggcggacggcggctttactgctgcggttttcggactgctgttgaataaacaaatggcgatagtgacgtagcgccagcgcttcggcctctttccccagatgttgcgtgacctcgatagtgtccagcggcgcatgttccgcctctttggtcacctgcggcagtgaaaagacactagcgataagtagcgaatgctgctgtagattatccgacagcgccgccaggtgttgttctatctggcgaaaagtgccattcaggcgttcaacgagatcgtagcgggacatggtatcactcactttagttacaacatactatctgtatagcacaattcccgcggctcaaccagcgtgcaaaatacgtcaggccgcggtcatgtcgggcatcgcgtgccagaccggccagcgaaagctaaattttgcgccgcccagttcgctatcgtcacagacgacgctaccgcccatcgccagagcgatagagtgtacgatggcgagtccaagcccgcagccgcctgtcgcccggtctctactggggtcgagtctgacaaaaggttcaaatacgcgctctcgcgcatccgcttcaatgccggggccatcatcttcgactatcagcgttgcctgactgccgtcaagtaacagactgacctgaacggtggtacggctgtagcgcaacgcattattcagcaggttatccagcactcgcgacattaaccgcatatcaagcgcgccataatcgccgattacacatgtgagaagatttacggcgcgttccgggttcacgctctgcacatcctgcaaatgcgcgaacaaccaggcggggaggtcgggtttggtcaacatcagttcattttgtggtcggtcaaggcgcgcataggtgagcagttcttcaatcagcgcttccagttgaccaatatcgcgattgagcgcctgtgattccggcggagtcagattttcactcatttcaagccgatagcgtaaacgtaccagcggcgtgcgaagctcatgggcgataccgtcaatcagctgttttttactggcgatcagagcattaatgttatccgccatctggttgaacgcgacgcccagacgttcgaaactggaaccattatcgaaatgcaggcgttcagtcaaatgaccctcgccaaagcgctgcgcggcggattcgagcctgagcatttcttgccagtgcgggcgcatccagataaacacaggaaaggcgagagaaaaggcaatgagcgccattaaggcgatatccagcagtcgcatttgatgcaggaaatagagatagggaaccgggccaaccgccaggacgtaatggctgcgcgggatacgctgaataaaggtgtattgatcgtcaagcgcgacaatatcgccttcacgcagtcgctgcgtggtggcggcatcaagcttatagtgatttaacggttcaacgcgtaaatcgaaagagaggttcaggtccatctcttttaacgttttcccccattcacgcggcggaatttcccgcagttcgctgcgcatcagatagagcgaacttttcatcagatcgtcgagcgattgcctgcccgcgcgttcggcagtgaatttgtacaccagtccgaccaataaggtcatgaccagaaaacagacgaacagcaaaaggtaaaactgcacaaacagctttttcatcaacgcccaccggatctcaatacattagctctatcgcgcgctgacggaaaagatttcccgtcagcgccgctggtgggttataaaagcaggctttgcgtcaactgacaacctcattgtccggcgttaaggtccggactttcgtgaacaatgcgtccatcgacaagcgtcaaaacagcgcgaatggtatcaattctgtcttccggcatcgtcataaagggctgattgagcaccgccagatcggcctgttttccgacgctaagctggccccggtgttgttcggcaaaggcgagccaggcggcatgacgtgtatataacgctagcgcttccagacgcgtgagccgctcgctggcgggtttacgcacggaaccgcctgacgctataccggtgatatgatattcgatagcgtgccagacaccggcaatgccaatacgcgtcgaatcggtgccgccagctacgacaagccctttatccagcgccagtcgaaccggcggcgaattgtccgtcgcaccgggtgggttggcgtcacggatggcaagcccctcaaagtaaggccccatttgcacagtgtatgccagacccagcttacgcattcgctcaagtgtctgtggcgaaccggtattcagatgcgcaatagaccagcggagagggcgcagatcgtactgctgcgctacctgctcaaaaatcgtcaatatcgcgtcggcgctgtcatcggtataggcgtggatctcaagcggtattccccgttttgccgcaaacgtcgcgacctggcgaagcgcggttttgtcctgctctgaggaagaaaaccctggggccatccgcacgccgtcattcattcctgccaccaggctttcccccaggccaagaaaagccagttgcccgtcgtcggcacgcgccgggcgaaaggccatcaggttgctgaaccactgcgcttcatgacctttcgcttccggctgtaccggaatgcgataccccacgcgcagcggtaaatccccctggtttcgcattgcaaataaaggctcataagcggcggcaggcccggcagaggggtcaatgatgccggtcacgccgcgagcgttcatatcagcgaaaaattgtcgcagaccgccctcgcgatcggcgttactacttatgctggcaaaaagctggttaaacgcggcgatgtcaccaaataatttccccgtggcgctaccttttgcgtcgcgctctacgcggattcccgctaaatcaggaggaggggtgtcgttaaggccaagtacgtctataccgcgctgattcactaacgcatagtcgtaaagatactgaatataagccggatgatcgggaagggcgtggctcagttcggctaccgtcgacgcccggttttctgcaaattgcgccggtatccatgatcccactacggctacccattgatcgtggggacgacggttagcgtcggcgcgtaatttatccagcgcgtctttaagcgaagggctgtcgtaccagtaggtttcgaatgtccaggtttgtccgccgcgaatggcgtgaatatgggtatcggtcaggccgggtatcacggttttaccctgtaaatcgatggtacgggtatggtcgccgcgccattcatttgtcgccgtatcatcgccaatcgccacaatccgcgagccggaaatcgccagcgcgctggcctgcggctgggcatcattcagagtgatgatattaccgttatgcaaaataatatccgctgccgggcgggcggcggtggctgcgcctgtggccgtgagcagaaagagaagcgcggttctggaaagcagaggcgggacgagactgatcattagcatgttccttttgtcgggagataagcaaaccatagagagcgaacaagaattgttcaatctgtgcccagggaacagtgcgttctgtttttagaacggtggtgatagaaaaagaaaagcccgccgaaacggcgggcttgagaagaattaatgaataattagaactggtaaaccatacccagcgcgacgatatcatcagtgctgataccggcatctttatagaacgggtcgtcgtcatccagcaggttgattttataatcaacataggtggagaagtttttgttgaaatagtaggtagcacctacatcagcatatttaaccaggtctttatcatcgccattaacgttgttataggtcagatctttacctttagacatcaggaaagaaaccgccgggcgcagaccgaaatcaaattgatattgggctgtaacttcgaagttttgcgttttgtttgctacgccgccatcataacccttgtccgttttaccataaggcgtcatattacgggtttcagaatacatagtcgctaaatagatgttgttggcatcatatttcaagccagctgtccatgcatccgctttgtcgccgccagcaatcgtgccgccagcattgacttgctcattagtacgatcggaagtggtatacgcagcgcctgcgctgaagcccatgccaatatcataggtagtagaaataccgaagccatcaccgttatcgtaacgaatatcgtcgccattattacggttattggtaccgatatttacatcgtcagcgctttggctttcatttttaccctgatattgcaacgcgaagttcagaccgtctaccagaccgaagaaatcagtgttacggtaggtggccacgccgttagcacgaccggtcatgtagttgtcagcgtaagtataggagtcgccgccgaactcaggcagcatatcggtccagccttccacgtcgtacaggacgccgtagttacgaccatagtcgaatgagccgtagtcgccgaatttcagaccggcgaatgccagacgagtccaggagttcgcgccttcgccttcggtagtgttagcctgaacgttatattcccactggccgtaaccggtcagttggtcgttaatctgcgtttcgcctttaaagccgacacgcatataggtctgatcgccatctttagaagagtcatcagagaaatagtgcaggccgtctactttcccgtaaaggtccagtttgttgccgtctttgttataaatttcagcggcgtgtgctgcgccagcagccagcagagccgggatgacaagtgccaatacttttcttttcatttttttatccttaaaaacttaacttatttgcaaaagattgaacttctacagattcgttgaatcaaaggcatcctaatctgaataatattatttcagcaaatgctaacttttcttatatgttattaattaatacaaaagttactatcggaaacgcatatatttatggtgaatatgtttgttattatatattcatggttgtgatttgtttgatttcacaatttgcgaaaaaagatggcaatatagcggcgggcagacattctgttatcaattttgtgaactggcttcgagttttttttaatttaattttcttgagcgaaaaagacgtaatcatgaaccgcaacgcagagaaaacggtaataaaggggctgttccgactaataaaaatagcactgatgtatacggtgtctgttttttgaacagtggcggtgatgagcatcgccactatgacttgataaaggcaggtaaaatctgtcgactcacttatcccgtcgtttcgtcccaggcatgaggggcaaaaagatagcctttattgcgaatggtctttatacgatagggctcagcagcgctatccagcagtttcttacgcaggcgggaaatcgccacatccacgctgcgatccagaccatcataattaacgccgcgcagcgtttttagcaacgcgtcgcgatccataatttgtccggcgtgtgtcgccagttcccagagcaattcaaaatcggcggtggagagcgatatgaaatcgccattgagctggaccgcccggttaaggggatcgatggttaacgcgccaaaacgcagcgctttatgcggcgtaagcgcgctctcctgaagactttttgcctgttgcgtttgttcgctttgccgcaggtgtaagcgcagacgcgccagcaaaacggccggaggcgtggttttgaggatgtagtcgcaggcgcccatctccagcgccagaatatgattcatatcactgtccagcgaggtgagcaggacaatcggaccttgccagcggtggcgtaaatcgcggcatatcgtcatgccatctttacctggaagcataatatccagtaaaaccagatcgggctgagtgatgaggataagatcctccgcccggtcaccacgcggctcaacaatgacatcaatatcatgtttcgccagataagcggcaatgagagaacccacttcagcgtcgtcttcaacaaatacaatgcggttcatattataaatggagaatagaaaacgccaacatacacctcctctgttttcccttccataaatcttttctaaacgagagcggttccgttatgctacatgctgttgttattagcatgttaaggcaaggtaatgggactcgtgattaaagctgccctgggggcgctggtcgtcgtattgattggtctgctgtcaaaaacaaaaaattattatatcgccggattaattcctctgtttccaacgtttgcgcttatcgcgcactatatcgtggctagcgagcggggcatcgacgcgatgcgtaccaccatcgtctttagcatgtggtcgatcattccttatttcatttatcttgcaacgctatggtatttcagcggcgtgatgcgcctgcccgtcgcgcttggcggtgcggtggtctgctgggggctaagcgcgtggctgctgattttttgctggattaaatggcattaatattggcaaagaccgtggtttccccatcgtaatacagacggatattacgatagggaggttgttaacccaccagcatccacgtagccggaaccgccgcgaccagcaataaaccaatcagcacgacttcctgacgatttaatacattgtcatgcttgtgcgtccgacgcgcatacaggaaaaccagtaatccaggcgcgtacagtacgacggacagcagcaggtgcatagggcccgacgcatataataaccataagccataaatacaggctccgataccgaccgcccgatggaggggacgcgttgcaatcttcagcagaaatgcgccgaccagaaagtagggcaccagaatcatttctgacgcaatcgtcaatagtgtgttgtagtccgaaccggtcagccagatcagcaccagacagatttgcacacagatgttggtgagccataacgacgcagaaggcgcgccttgcgcattttgtcgcgcgaagatgcccgggaaggatttataggctgccgccagaaacggcacctctgccgccatgatagtccagcttagataagccccgcagacagacacaatcagtcccgctgcaataataatttctccccacggccccatcattttcaccatcagaccggccatcgacgggttgcgcatctccgccagttccggacgcgcaagaacgccaagagaaagcagcgtgaccaggagatatattcccagcgctgcgagtaccgccagtagcgtggcgcggcctacatcgcgtttatttttcgctcgggccgagacgacgacggcgccttcaacgccaataaacacccacagcgtaataagcatggtgttcttgacctgttcccatacgggaataccgagctcaacaccggtgaagtccagtgtgaaggtatccagtttgaacatcatgatagccagcacaataaacgcgccgagcggtaacagtttcgccagagtcgcgaccagattgatgctggctgccgtttgtacgccgcgcaggatgaggaaatggacaatccagagcaggactgaagcgccgacaatagcctgccaggtattaccgtcgccaaacagacgcagggcaggcgtatcggtaaagaaactcagcgctgaaaagacgataaccaaataggatacgttggcgatgaccgcgcacagccaatagccccaggcagaacaaaagccaatcagttcgccgaagccttcgcgggcgtaagtaaagatgccgccgtcaagctcggagcgaatgcgcgtaaggattaacatggcgaatgccagtaggagtatccccacgccggtaatggcccagccaattaacaacgcagccggactggcaacggcggccatattctggggcagactgaaaacacctgcgccaagcattgagcttaaaaccagcgcggtcagcgcgctcagtcccagttttttttccattggtatccagctataaaaatgaaattggaagaataattattatggcaaaacgcataaaaatggtgaaagccactaaggcgcgggattttacggagagaagggaccgcatgcaacggcctggataagatttatcgccaaaaaagcgaaaagtgagattcatcgcgatatttgacggaactggcatcccgcgagaaagcctgattgatgcgccgcgcgataaacgtacctatttccgtgagataaattacatcgccgcggcatttcaatatcagaaaaagaattacaactcagcttgagtttgaagttcctctacagggtgataacgataaatcgtcgatataccgatatcgtaaataattgccaactgtttcctgctatagccatttttgatcagccttgctatttgttcatgttgctcttttgtcagtttcggacgacgtccaccaatacgcccctgtgcacgtgctgcttcaagtccggccagtgttcgttcaactattaattcacgctccatttccgctaaagcccccatgacgtgaaaaaagaaacgtcccatgggtgttgacgtatcaatgctgtctgtaagactacggaagttaacccctttttcccgcagttcctcaataagagtgatgaggtgtttcatgcttctgcccagcctgtccagcttccagacaacgagcgtatctccttctgataacgttctgagcagctttttcaatcccggtcgggctgactttgttccgctgattttatcctcaaaaatcagttcacatcctgcgcagttcagtgcgtttcgttgtaaatctgtattctggtcatttgttgacacacgaatgtagccaatttgcatgaaaaatatcctctttgttttgttaaaaatacatagctggtataggtgggagttaagacgaaaacgttggtttgggggaaggctctgcactgcccgttggtgtgcctgttccgtggccctcagccacaccgccagcagggtggctgaaatgtaacggagcagcattttcttctgaaatgtaccccaatctggcaaaggcttaccccgcgaataaattaccggatttacggggtgagtttattcgtggctgggatgacgagcgcgggattgatcctggtcgccagttgcttgagtggcagaaaggtactttggttggtggtagagatgacaatgatgccgcagttgatatttcatatatgagtaacggaaatagtattgattacggtggcgataaaacattttcaacgaattaccggagtgattatttatggtatgcaattctgggtaacgtcactggtcgtgccaaagctgctttaagtgggtccttttttaatgtaactcgtccacgcaacatcgcctttaactacattgtgagagcaacatagaaacgttggtttgggggaaggctctgcactgcccgttggtgtacctgttccgtggccctcagccacaccgccagcagggtggctgaaatgtaacggagcagcattttcttctgaaatgtaccccaaactggcaaaggcttaccccacgaataaattaccggatttacggggtgagtttattcgtggctgggatgacgggcggggaattgattcagggcgttccttgcttaatgcacaatcacattcggttatagatcatattcactatatggagttatggactggtgaagggcttgccgcaaatagcacccgtgcaggaacaaaccctggtatactggctacatacggtgatggcgggattgttaaaacagatgagtcaggtgtaaaagttccatcttcactacgtgctattggcactcgtggtgtttatagattaggtgccaacggagggaatacaggaacggaaaaccgcccccgtaatattgcgtttaactatattgtaagggctacttaatgaataatgctgctgcagtacttgatcagaatggtatcgctataactgcaggcgatattaccgtttataactacgatgctgaaaaccgtgaatatctctctgccactgttgagtatctcgcttatggtgttggaattccggctcactcatgcattgacgcgccaccagaaaaacgccccggcttcgctgtctgtcgtgataccgaccagaacatctggaaatatgttccagaccacagaggcgaaacggtttacagcacagagaatggtaacgctgtgcaaatcacacaaccgggagattaccctcctgatacgacggtgaaacagccagctactatctatgatgtctgggatggtgagacctgggtgacagatgcgggacgacagcacgcagcagaactggaagctgccggagcgcatcgtcagcaacttgaggaacaggcaatggcatctgttgagcttataaatctcaaactacgagccggacgccgattgacgccccaggagacggaaaaactaaacgccgtgcttgatttcatagatgtgcttaatgcgactgacatcagcactgcaccggatatcaactggccggaaatgcctctggcagcagccagttgaatataactaagccgccctcacgatatagttaaatgcaatattgcgggggcgggtttcactaccacctgtgttaccaatacttcctcgtgaatgaagcgttggtgatggaatcaaactccctcctgtatttgtggcatcaagccccctgccttgtgtatatgtttttttgaaaatcgtggccaactcccattcatcttttgtgtcatatccatcgttagctacaacaatatggcggtgtttttccaacatcccgttttgaatgctcaataaagcgcgtgccgcatcaattcctcgcccatcatcccagccacgaataaactcaccccgtaaatccggtaatttattcgcggggtaagcctttgccagtttggggtacatttcagaagaaaatgctgcgccgttacatttcagccatccctctggcagtgttgctgacggccacggaacaggtacaccaacgggcagtgcagagccttcccccaaaccaacgtttctatgccgcccttacgatgtaattaaacgcaatgttacgggggcgggtttcagttgcgccgacaatactggtacttagacccgttgctgttcgtttgttatttttattcccttcgatcagacagttgtaatcgtcattaccaattaacgaattggtggcatcaataccgtccggtgacaaggcattagttgtggaacttaaagtcagcatctcgtctgaacttggaagattttttaatgggatttcattgcgtgaaatacccgcataaaaaaaggactcatgcctgtgcgcttcaaaagagtcatcctgaagccttagcaaggctcgccccgcatccacgccacgtccgtcatcccagccacggataaattcaccccgtagatccggtagtttatttgtaggataagcctttgccagattggggtacatttcagaagaaaatgctgctccgttacatttcagccaccctgctggcggtgtggctgagggccacggaacaggcacaccaacgggcagtgccgagccttcccccaaaccaaggtttttgacaaacagcgcaggctcaggaatatctgcgccgttctggtctttagccagcttttccgccagcttgttcagtaccgtagtcgcaaagtttggatcattaccgagagcgtcagccagctctttaagcgtatccagtgtctcaggggcgctgcctgcaagtgccgcaagtgctttggccacaaactccgtcgtcgccagctttttgctgttatcaccatttgcaggtgtaggtgctgttggtgtgccggtgaatgtcggactggctttcgtcgcgtactgggtatgcgggtcaactgccgcgatatgtgcagccaggtctgttccgcttttttcgaccttctgtttgaggtatgacgttcggctggccagttgtttagcctggcggttagaaattccgtcaggtccgcccagaacggggtcagagacctcaatctggtagatgccgctttcccactgcggggtttcgggtagatttgccataattaactgctcccgtggttgtaactaccgtcataacgggtagtactgttgtatcgaatggcgacagactgatattccagacttgccagatgacagcgagccggagcaaaggcagcaagcgtctgacgtaacagcgccgcctgatcgttagtgatgggttgttgaaggatgacgcgatagactgcccaggcttgtgcatcaccatggacgaaaagcccgttgtacgtgtgtctgccgtcatagccaatctgccccgtaccttcaatcagatccacttcgccgaagccaaaacggcggataatttcccggattgaccacggtgttcctttatagcggtgtagctcgatagcggatttgataagcatgcggcgtacatcgtccgattccgccagttcccagccatcgccgaacagcgagaactgctcgccaagccatggcagcgcggaactgtcgacaatatcgacgagaccgaccatcagtacgctcaggtcgatgttatccagccgtccggccagtcttcccagcgttctgagactgatatcaccctcaagcggtggcgggagttgtagcacctcagccatcggacaccccggtcatgttaagagtgatcgctgtacagtttgcccattcgttttctgccaccaccctcagtgccggtgtcaccagttcgacctggtacaccccggaaacggacaacacgctgataatctggctgggaacaatatcgcgccccagcgtggcggtacgggatgccacccagttctgtatggcgctgttagcgttgtcctttaccaaccttgcatcctgatcacgatagatcgtaatcctggcttcaatggtgtaatccacctgaacaggtgttttagcccgcacggtatcagtgagtggtctgactttttcgtcagaacagaaactctctaccagagtgaggatactgctgtccggtagaccagtgctgagcagcggatacagctcgacagtgccgggagcgggagaaagaacagcaacgtcgacaatgccgggatgcgcccccatagcatgaaaacggtatgcaccacggcttccggcattggtgaatgactccggggccagcctgatacgctcccggagccggtcatcgtcttcctgctctgaaccgccagagctggccgtcagattggtcaccagcaggtcaatgttatcaatctcatcgagtaactgactgacctgcgccggttgccagccgttgccagcggtacccggctcggtacaggtggccgtgacattgaccagcagcaatccggccttcagcaccacatctgtatcggtggcaaaaataatactgtcggaagcgctgacgcgggtgcctgccgggatcagcacatcaatggccagtgcctcatccacagagaactgaagtgtggtggtggcaggctgcgcagcaaggcggtatacgtcgaccagttcaccgaggtaatcaatcatcggctcacgggaaaaagcgaccagattctgcttcgccgcctcctgtactgccaccctgaccagcatttcgcgataggcccacaggtcaatcagcagacgttcagcctgtgccgggtacagcgtttttccggtatccgcttcatacttcgcaatcatttctgccgtgattttatcggcatcgcgttcaataaaatcgggttctgtcagcgccatagcagttcctgagtacggggttgtccgtctgagcctttccagctcacccggagcgtaagatgttcgccgtcgacggcgggtttaaccgacataagctggcagcggggttcccagcgcctgatggcatcgacggattcgcgaaccacatgcggaatggcccggccgacaggccagtcgatataaaggtgcagattgctgccgaactccgggcgatgcgggtcgctgccgcggggagtccgcaggatgatctggatggactgccggatatcatccagcccccggacgatttcgccgggagcctgcagagctggttgccagaatactgaggtcgttttcatggaggcagtattgcccccgggaagtaagcgccgatattaaaggcgtttaagaaggttcaatgggaatggtgattagagttctgaccatcagcaaatatgttacccgttgcatgggcgcttccgttgatttccagatcaccattgagtgtcgcggggccgttgatcgtggtaactcccgtgaggtcgaggtttttccctttgagagagatatcagcggcaacctccaccacgatacgctcaatacctcctctgaccgtcagcgtatgggtcgcgcggttataactgaactccgcgccatcagcgtatttcgtaccccggacgtttttatcactgaacggcggtttatcgacgtctgagtacaccgcgcccagaataacaccatcctcgccgttggcatcgagcagcacctcaacctgctcccccacgtcagggagccagtaatccttgttatcctgggtattgcgctgtagcacgttaagccagtttgtgcgcagattatcgcattcaggcagacgaacgcgggcctgaaccctgtcggcatcaacggcactgaccgtaccgatctgacgggtgacaccagtcattttttcttctccttaatcaccgtcgatgtactgccatccgggtgataaaccgtgagtttctgagttttttgttttttccctcttgtgactggcccccgtgccacttccagctctgtggtgtagccgctgttacgctcaaacgcatggcgggcagtgattatcagccatggaccggataactgtccaaagcccaccagttcaattttgttgcctgctgtcagttgaggcgttcccgtcagcgtcagggagccgttctgctggtattcgttatgtctggccagtgctgaatccgctttaatccgggcgctgtccgggtcgctgacgcggctgttaactttaagtgagtcagcgctggtaaccttaccgcctttgagctttttgtcgctttcacgggtaccaccatcagcttcgtagacgatcagttttttactgctgcttttctggtgttttacctttgcagatttatagacccggttgatggtgtcacgcagggaaaagcgggccacaccctgcggttttaactgcctgaccggctcctgactgcgcagtgtggccagatgagaaaaaatcaactggtcactgaccactttcactgcataaccatactcgctggccagccggcgcagaaaacccacgtcggtttcagcatactgggtcacccggtcgattttgatggactcaatgctgcccaccagtttcagtcggtgctttctggcaatccgccccgcaacagctgccagcgtggtgttctcaaaaccacggctggatttagtccgcagagcactgttaaccgaggtggccaccccacggatagcgacaacggacgcgggcgaactcacttcgatctcgtctattgagaatgtaccgcaggacagcagtttctcgccctgataacccattttcagcgtcagcgtgtcacccttgcccggataccacttatccagccagcgaccatcggtgtcatccagctccacctcaatggtatcggactcatttttgatgttatcgctccagaccacacgggtgacataaggcgcgatatcagaggtgatgtttttctgcagataccacagagtgaataccggcgtcagcacatcgctgacgctggttaacgctgatgtggcttgcgcagtactgtttatctcagccatggggcaatatcctcttctgtacgggcatcttcagcctcaataaccgggatcagtaacaacaacccggagggcagcaccggcgtaatggccacgtgcggattggctgcaataatccggggatagcccagcgggtcaccgtagtactgccatgccagcgaatcccagcgctctccgtcacgggtaatatgttcaagaaacatcacacactcctcgtcagtattctggcggccattgcacttaatcccggagacatgcggttgaatgctgtgccggcggcgttaagctgcccggaaacggtatccagagcacctgcaatatttcttttgtccacaccactcagcgccgactgcgcctgctgtacatacgtggctgcctcactggctgttctggccagactgatggcatcgggcatggattcagagagtgcattaaacgccggaacacttttccccagagctccggatatattacccagtccgctcatcagtcccggcacacgggtcagcgcgacaacggggttacctttcattttctgcgccacccgaacggcactgatagtggtctggagtacagactgcgcctgtttcgcatagttgacgccgttacggacgaactgcgccaccccggaaggcgatggaacagcacccgatacagctccggcaccgggaacctgcctgcgtattgccggcggttgcagaggatttttcgggtcaccggtgtattcccggagagacacggtggcactgacagccagcacgttaccggtgctgtctgtctgctcgctggttgcggtcacatcggtaatcacgaaccagccgcgatagtcaccgttgccgaagaccagcgccagtgcctgatgggccttcatggctgttcgcactctcgccagctccacgtcgggcacacaataatgctgatggaagactaggcttatctggatttcgtccagcctgtcgccgacaaactgcaggccgggtttaccctcgatgcgggcatgctccgcataatcgacgccgaacgtggcctcgaagccgtcccagtaggtaatcagttcaaactcaatatcacccagtacggcaaacatcagctgtactccttacgttgtttctgagccagcagacgctccagcattttttccagctcatgcaggctcatattcagggcaccagtcagcccggcaggcgctgcggtttccttaccattgaggaaaaactgaggattaaagctgaccttgataccgccagacgctccaccgccagttgcagttgcgccacggcctgaatatccggcagccatgatttccggcgacgggatacggggaacatccggtgtcatttcagcggccaggcgctgcccggccagtgcagcaagcggagtggtccgttgcaggccaatggcggcaccctgcgcgatattgtcaccaaagcccataaacacgcgactcggtgaatggatgcccagcttttcgctgaaccagtcactgatgctgtcacccattccggttacgctggttttgagtgacgcccatttgtttctgatgccatttatcaacccgtcaataagatgaccaccgaagtcggtgaatttcgccggcagatcaacgccgagatatttcagcgcagccgcaaaggctttataaagcagaccagccggagaccagttaaccagcagtttaccaattcccacgatgccgccgttaaaggcttcctgaatgtcagcccagcgctgtttaaaccagctactgactgcgccccagttgcggtagataaggtaagctgctgccgcgacggcggtgataacgagaccgatgggattcatcagcagcgcccggccaatccagagaacggcacgcccggcgctcataattccgcgaaccagcccccctgagagcacaccacccagtgttctggctcctctggcgacagcaccaaagcctgtcaccagccagcggagtttaccgccttcccccagtgcgagcgtcagacgaagccagttggcccgaagtaaaacagcatttttccagacgcttacaaagggggaaagaaggagattcagcccaagcttgagaccgatagtggccatcctgaaagcgagtaatgcgcccacaacctttatggtgctgctgacgagctgcggatttgccgctatccatttgccaacactgtccattaaaggaataaatgtttcacccaactggagcaaagccggacgcaaggattgcccgatgctgatagcagaatcattaaagccgatctgcattctgcgccagcgaccttcaagcgtatcattctgctttgcagcatccttatccagggtagaaattgcagccggagcattcatttcctgcttactggaaaggtatttatcccagccctgtcgcattgacagtaaatggttgacagtctgaatatcggtaaagacctcagccagaccaaatgactccatgagtttctgctgaccttcctgatcgcctcttgctcctgcagctttccattgctgcaagaacgctttgcctttactgtcgataaaacggttggcaatcatcagtgaagcttcgtactgcgaaaaaccctgagcgacgtaattctgcattgacccctggtaatccaccccggctttagcatatttctggatggtatctccgcggcccattgctgccagccagttggacatattggtgaccgcttcctctgcagagccactacctttaccgacctccagactggcaacaatctgggtaatcgcatcttttccataaataccacgagcagcgaaggctttagccataccgggtaatgcttttgccatatccttcagctcaaatgacccaagtttggctcctgttgccgcaataccaaacgcctgttcaagttctttcgcatcagtgattctgagtgcatcgctgaaggcataagtcattttggcaaggtcggtcatatcggctttggttgctgtagcggtctttccaagcatctctgcaaacgttgctgcccgttcgggggccataccatcagcaactaattgtccgactccccctaacagagactcctgcagttggttaaccttcagcgaggcttgtctgatagcctggccaattgcacgttcctgttttgcatccaggtctcctgtgacactgatatcccgcaactgtgattcaaacgaggcatattgtttaaccgaggccatgaccggtgcgcccagcgttctgccaatagcataggtttctgcaccctgaccatagagcgccaggcggttagccttcaacgcatcaccggtggctgatactgctgacagacggcgctgctgacgttcaatttgctccatggtgcggcttacccgcagcaactcgctgttgagatgctgcatccgggaagaacccagttgaccataacgttctgttgcccgggttaaggcattctggcgttcctgcagacggcgggaggtatcaccaagggaatcaagggcgcgtcgggtgccactgacggctgagcggaagctgctcccgacaatgccgccaataatgacgccgactgaaaattcactggccacggtggctatcctctgaaagcaaaaaaaacggaagggaagtgtctgaaacccatgcagaacagccgcgactggcggctgttaagtgatacgttgttactgattgtcgccgaactcgcttttgatttgctcttcagcctgctccagccacatctccagatcgtcagtatcgagggcatcaatctcccccggttgaaacctgaaccatctcgccagcaggccctgcgcctgcatcagtgtttttgtcgctcttgcccagcccagtgattttctgaaatcgtttctgcagctccatatagtcggcaagatccatgttatcgaggtcttccgggaggataccggtgctacgggcaatcagtggttcgtcccagtctgccgggtctttgttgattttgcgcacctgcttcaggtcttttactgtcaggcgtttcagttcaatctgttcaattctggtacctgcagcagtggtgaaaggataagacagcgtaaaagtatcggactgggtctgtgacatgatcatactcctttgtaaattcagagcagtatgtctggcggtggacgtgacggatattaaaggggattaagaagaaggggccggagcccctgtgatgtcagcaagtgcgaaaacccttgcagttacgcaggaaagcgatgagaagcgcctttccctcagatttgccggtgccggagaaccactggtcgggcggcttccatgcttcaatcaaatcggccagtttgcgggcctttgaacgtgtgcagtcaatcgggtcattggttttacgggtattaaagagggtctccacccccggaatatcaaggagggtaaaccacgtaccatttgacatgcccagtgacgcacatcgccctcctttgtcagtcagttcaacactcaccgtcagcccccgatattgattcgatagtcagtcagttgatcaacgccaccgacgcggaagatgttggccagatagtccagttgcagcaactcttcaccatccagtacctgtctgatatacgtgcaggtgaagctactggagaactcggcgttctcgtgctgtttgaacgtccccagcgggttcttcttgaacataattgtcaggaaggtgaccagcgggatttcgtcgatcagcccctgcgagctgtagcgctggacgctggagcgacactgcagcgccagcgacttgtacgggttcgcggcagacaacatcgcatcgcggtaaaagctgttccatttgatttcgccttccagtttgtcaaaaccagccgggagttccaccttacccaccatccccagtgccttgtgctcctgcataatcatggagacatcggggagtttaacttcctcagcccgtcccagcaggttagtaccatccagatagatgttggcattcgtgattcggtttatctcaatctttgacatcagttgccccctttcagggttaacaggtattccgaggtgatttcagtctcaaacgtcagtcgctccagcggcggtggtggcgtatatttgtagctcagcaacaggtgcccggcggccagctccgtctccggattgcgggccggatcaaaccagcaacggaagcccagtaccgcaccatcaccagtcattttgcgaccgtaggcgttgaccgactccgtcagtgcatcaatcagcgcctgagtaatcggcatgtcgatgtactgctggctgaagtaacgaatggactcgttgatcacatcaccggtgcggcgaacgttctcaaagttacgcatatgggtgaccgttggccatgctgccgtccggttaccccacagatgaaggccgctgccgtaactgctgaataccgtggtgatcccctgttcgttaagcaggttcacctcgctctgcggatcgtcaatcattgccgacagctggcgctccacgccggtgatccccagaatttcctgattggaggatgaccaccagtaccctttgtccaggtcgactttggcacgcaggcccgccgcacgctggctcagtggctccagacgctccgtgttcgtcaccgggtcatataccttcacatgcgggtagcacaggcggacacggtcagagctggtattaaagttaatggtgccttccgggccacgtcccgccagagcctgcgcaaaagtggtaccaaccggcgcatcaatataggttactgctcccagtttctcagccatggcgataagctcaaccgagacgctgttctgggtgcagaataccggagcaatcaggattttggcgaagtagccaaacaggttaaaactgtcgttaagcagcttcatgccggtacggttgcctgcagcgttaacggtaccgatgatatcagccggggtgactttggtcggatcagcatagttatagctggccttcaccgttgcatctgcagcaatgcttttacccaggttagtaatcaccccggtctgtgcatcaagcgagtagtcctgaccttcaacataaggctgaccgttgctgtccggtttcagtaccagctgcgcgaccaccggattagccagccgggctctgcctgtcgccttgtcgaacgacacattctcactgaccacagcgattttatgcacagacggatcgagtacgttaatgaccagaacggtgcctgcaccatggtcataaatcgcatccagcgcctgcggaatggtaaagccggtgaactggctgccaaatgccgcagcgtctttctcagacaggcactgtaccagcgtattgacatcccccatcggggcggtaccaatcaggccaataacggcagatttcaccgttttaaccgggcgggctccgttttccacctcaatggtttcgacgccatgcagatagttagctgccatgggagtcctccgttttcacttcgctgtcactgctgcttctgcgctttggtgactgcacagccggtgtgacggcgggtttagtatcttctggtaccggcgtcagatgcttcagcgccaccagtaccttcacgtagtcatgctcctccggcagggaaaccgtcttccccggccagagcaggatttcggttccgtccgacagcgtgacgccgctggccgggccggaatagcggtattctttcatcactcgctttcctcatagttcacttcggttaacagcgggccggacggtaaatcgctgtcttcgataaagacgctttcagtcgcgaagtcgagggcgtattgccacagccccctgacttcaccgataaacacctcgcgggtcagccagatacggcggcggcagccgggcggggtgtggccgccgagaatgcggcggacagcatccaggacattaatcgccccttttttaccgttgagctggcggaagaccaccgtgacgcagagctggatagtctgagactggatcaccgcaccggtatcatccggcctgtcaaagcgcgaaccggcatagctcagcagcaacgcgccaaccggatggttcaggcgatattcagccggtttctccgggaagtactccacctgcagttgcggcagcttctcgcgtaaccgggccagtaccgcatcaaggacgggcagaacgttcatcagtatttctccagtaaaccgtcacgaccgccgaaagtggccgggcggctgcgtacacgaaactcgccaggctcaggcacatctttctgagtggacggcagccccagcgtgagcctgttatcacgtaactccctgagttgccgcagcgcttctttgtggtcatccttcaccgtatccgggaggtcaccttccgggcggcgggcgtagagccggtaacggaccagcgtgatggcaatgtcccgcagaacagtcggtatctctgccagtggcaggatatagcgtccgcgcagatgggcatcaatcagctcgtcggcatagcggatacagctgtccaccacacgggtattcactgttgcaggcgagtcgaagtccatctcttcactggtgagctcgatcagcgttcgttccggcacctgcgcaagcaaatcctccagggtgcagtacatgtcacaccccgcgcaggatacgaatgacgtcgccttcacccccggcttcatcaagtgcaataccacaggatttaccgtcgccggactgcggcacggctctggcctgagcatctgactgaacagccacaccacggctgacagcggccccggcctcgacagcaataatgcccagaacgctcaccggcgtgctgtcgccggtaacagcatccacttcggcaaccccgagcgctgcggcaccggctttacagggggtattatctgccccgacaaaacgctgctgtgccagtgcggcccctgccgttacggttgtgatcagaatgacctgctgagtggttcccataacgcctccttatttactgataccggtaatgagatacccggcatcgccaccaaccacggcgactttgtagatatcggtataacggcagtacttcaccttgccgccggctccgtcgtacttgtcggcaacaggcatccccttacggcgcagggtgtagccgaaggacggctcgttctcgtccgcgctgtccgcccccggctgcggcttgccgacgtaatgcagcatcagattgtctccccagatatccgtcggcacgctgtccttatccattgccgctttcatggacggcagggagacaggagcaccgatgacgatctcttcgatctgaaagaggtcctgcaggatctccgtggtgatgcgcttgcgttcgttggctccgatggctgcctgaattgccgggtggaacttcagcagcgccatcacgccggcccccatggtcatcaggttaggacgcagccccgtggccgtacggaccgcttccataccggcttcaattaccccgatggggtcccccttaccaccggcccagcggtcgccggctgtcagttttttaacgtgcccggtacggtagaccttttcatcctgagccagacgggcggcgataagttcacggcgcagattcacgccattcgtggcgcgacggatggccttgctctcctcgttaaacatggactccgcctgttcgcgatagtccactggcgcagccagatcgtgctcacccagcaccagatcaagcgtgccggttttctcacggaccagaacattgctgtccgccccgacggcacgctcggtgtcatattccacaaaggcggttttcccgaaggtcggcacacgcacgccttccttgtccgtcagcacgacggggaaaatacgttcgccaatgaatgcggcatttttatagcctcgggcgatactggtcagtaccggatcaacgacacgtttaccttttaagtaatcagacatgctctctccttaaattacaggcagcgtgcgacagcagcctcatagctgatgccttcttttttggacagggccactgctttctgatgcagggccagacgctcaggatcggcttccgcaaactccgccacatccaccttcaccgcgtcgccgacacgatcctttgtggcctgttcggcgaagttcatcaccggctccccgtcggagagcaatgaacggaaggcggtggccagcggtgtgcggctttccccctcagcaaactccaccggcttgtcgccaccggcgacggcatccagcagggcaaccaccacggaggaggcgcggggagccagacgcccctctgcgaccagtttttctgcaaaggccacattgtccttatgcagttgctcctgtctgacctgtgcatcacgcgcatcgcgatcagcagcctgctgcttcaggcggcggttctcctcctgaagggcttcaatctcttcttttgtcatcgatgattcctcgttacttgcggaagacggccccgggcctgtctcactgaattgtgcacctgctgcatcctgcgacagtgtgtcgcggtacgcctcttcgcgcagactgttgagctgccattccggcaggactttttctgcctcgtccagactgaagcgggcgatcagaaaatcgcgcagctttccccacagggaggcattcgtgatggcctgccagtcggcgaactccaccacaccttcttcctgctcactgaaggacacctgtttcagccctttgacggaaggtggctgtgccccgagaaagcccacatggcgaaggtagagcacgccgggcttcggattggacggtgaatccgggaggtagaaagaggcggacacttttttgaatcgtccgtcggtgaccatctcagcaaactgcgggtccagctgggcaggctctgccatcagatcgacgccgctgagcgacagggctttcacccagccccacgccgggtcttccgttctgggatgaccaatcacgagtggtgcttcatggacggacgggtcataggctttcacgcaggcggcaagatcgtctggcgtgaacggcagttttttgccgtgcatatcggtatgagtaccggctttaaaaatgtgaatggctgacattttgctgtcccgcgttatgttgtcggagacagtttgtgagaaatgcaggcccggcgattttaatctgctttagaaaacatcaggggagaaggacagggaaagcaatgcggtgaaccggaggcggttataaaacagaggctgtaaagcctttataaaggtaatacagcccctcattcgctggcaatgataaatcacccacctgaagagagaaaactcagcgacgggccgctgattcaagatggcggacaatggtatcgaggatggggattaccacttcaggctgtagttctccatcccccgtcaccggcaggaacgggcgggccggaagttcaacagactcattacgccccgttttacccccgaactggtgaatggcaccgtaaacaacgttggtccccacaacagcctgccggtcgtcatggtcggttgatactgaccccatcagacgcccggtatcctgcagtgtctgcccgtcacgttcttccgctgccagcgagggcatccaccccggacgcccctcatcaagaaagttaaactgtgtttccgccagcagggttccggcgattttgcgcatcgcgggctccatgtctgtggcagccagatccagcgcacggaggctccggcgcagggatttatcgttaatggtgatactgaccaggttatcggaagccattgttatcctctcagttcctgttgtgccagtggctgaagcgtaccttgatagcgggccaggtcgggacggtatgctgcccccggtgcataagaccagccgacgtcggtggtcaccttcgtggtgccggtattaaaggtggccacgttccgcatttcgccggttttctctgagaccagtttcagttcctggcccatggcagagccggagctgataaccttcaggccacgggcacgtacatccgtcgcactcagggcaatcacactacagcggcagcgccagccgttcggcgggtaaaatgcctgccagaacgggtcatcccagcgcagcaccagaccatgcagcgccagatggctcctgcgggtatggctgtcgttgatgccggtatacatccagtacggcctgtcgtcgacgttttccatctgttccgcccaacgaccggcgctgtagagtacggacatattggtgcgaaagatggtatcgagccgccacggactgccctgctgaatggtgaccggcttacccgttaccgggtcagtcgtgtcacgtggtccccaccatcccttacgcttcagcaccggctccagctcctgccggaaccagcgatcggtttttccttcatcgacagcctgctgcagtgccccgcgaatatcttccaggatatccaggcgggtcactttagcaacggtaaaggcgcgggcatgggcctcctgccacatttcttcccagtcccaggtaatctgataccctttggacttcaggtaactgactgcccgcttcgggggaagcgtcatgcagtacgccagttcagccgttgtcacgctcatgcaggcgtccccagatatttgccacaaagagaatgcgggccagccgttcctgcagatcgtccgtgttcatctgagggtagagctccgccagttcgcccagcagctcagtcgggttaaccccgttttcgacccgcttaaacagaggtgccaggacgggttccagcgtgccatttaacacacctccgttcatcagaatgtccagcgcgtcgtcaagctgctgctgagcctgaatatcggcatcaatcgcctcggcaaatgacagcggcagcatgttattctggcgttccgacggtggtgtctcgtcaatatcgccgtcctgcagctggtactcacgcttaaagtattgcggggtcagacgcagacccgcccgggtgagtttttcgtcgcgggtggcgcgggtgtcatcaatggtctcctgttcccacatggcccagaccggacacggcacatcgccgaagttcagggtgaccaccgttctgataacctgattcactgctgcctgaatgatgtccgcatccgcatcgcggatatcagccgttacctccagcccggcctgtgctgaggccttgttactgttcgcttccgtggtctgattctgaccaagtaatgcaatggagatctcactgcgtgacagtgtgatcagctcgcggaatacctcgctgctgtccgccttaccatccgcggctttgagttcgatgctgctgtcatcggggatggcggccaccgcgtcctccaccatctgctccatggagtccagcagtttttcaatctctgcatcatttgcacccctcgggtgcttaccgatcacccacggggagccaaacttttcggcaaagcggagccagaatttcatcccgcctttcttgaaggcgaccggccagaagcacatggacaggtccgggaaaccgtaaggattgtcatacgaggcatcctgtgccggcaccacgaattttgacggtgacagcagctcaccctccacacccgcatcacgcgcccggaagcgcaggcagttgtccgtatcaaactgaaaccactcaggcggtttgccgacaatatccgtcactgcccacgccctgaccgaacggccccacatgatttcacagggctgatacccgtagagcacggcatcactcatctcaccgatgatgcgggacagatccagatcgtcgagcatgtcgcggatgaaacggaagacccgggcagaagcgtgaccgcgctccagtccacgctccagtgatttgagcgctgctttacgtctgcggatacagcccccaaccagcgggtcggtgcgcagttcgcggtagatacggatatcccgtccctgagccttgagaatgggatcaggattgggcagatacatgcccagtccgtaaaagtcgatcgcgcggctgcgggaggcaatctgcgcggtcagtgatttctgaggctcagaaaaagcaacaaattcatcgggtgaaacccagatacccctcgccatcagaatccctccagcatacgggccgcctgacgacgacagcgtgagcttgccttcaccggccctttgttaatttcacggctggcgaaatacgccagcgccagtgcgatggctgaatccccgtggcgtttaccaccgtcagcctttgcttttgagcgttgctccggcacgcgggggacaccgttcaccacctgaacggcccgcaggtcatccagtgtgtcttcatcctttggtaagtccaccaggttaccgtcttccagtgcagctttgaccggaggcatatgctcccggtaccagccttcagttggcatcacctgctgaacccggctggagccgtagcgctgcatggcgtattcagccagataggcaccattaccacgggcatcaaacgctgcacccagcagaccgggcaggccatccatcagataccaggtgatttgctcctgctgtctgaacggcacgttacgcagctccagtacgaatggcacgcgtcgtaccaggttcttctcctgcagcaggggatagtccaccgacaaatcaccgctacggccaaagtcgcgccccaggaaagagcgggcatcagcggggagtgcctccagcaagggtttcagatgctcatcaagccagtcctgtgtctcgtggaagcgaacctcatcagacagcagttcataaccttcctgacaggtcagacgcaataccggcgtatcagcggacatgcgggactctatcagggcacgggacagccaggcgccgccaccgttggccggaatacagtcaagctcttcggatgcgccggcagcgtagaatttgtacaccgacgccatccaggcctgctcggatgcctctgaccattccttcccggtgcgcagacaaacgcgccggaacagcccctcagatacggcttcccggaaagtgatgcgatgtacgctgcctccctgacgtccggcacggatatccccgataagcgtattgaacggattgtcgtcaccgtcatgggtggagataacgcgtacctttcccccccagataagcatcgccagcgccgctttcagcagttcgtccagttgctcatggaacgccgcttcgtcgataacaataataccctgacggccacgcaggttagacgggcggctggagagcgcaacaatacgaaagccggagtcaggaaatttgatggtgtaagtcttgatgtgtttgtcgtcgtcgtcctcttcccagaatccttcttcaatttcactggccgcatagttgaatgcccgtgcccacattgcacacgcctgaatgtattcgacggtcatgtcctggttataagcgatgtaatacacattcatcccgcctgctggcgcagaagaggcggcggtcagtacgttatcggatgcctcagcccatgtaataccggtacgacggctcttttctatcaccttaagcggagaggtgtctgccacccagcgctgctggtaaggcaacagaacgggaggggcatccagcgccgaggtatcaggcaaaacgggagcaaggttattcctcccgtccatgggactcatcccttcggggccgccgccagcggcgtttaaaatcactccggatgattttgtcatgtggcaatccccagaatctcgcgacgaagcgcctgtactgcgtcgcttgacagtccccccttacgggcaattttctcggcgttgctggctgcctgctgcgctctggcccgtacttcagactggaactttttgaggttgacggacgcgcgggacagcgtagccacattcttcgccaccttcgacagcagggccacgcgttctttaggatcgacttcgccttcttccgcctcctgcaactggacaatactctcgaacagctcggtctgaataagggctatcacagcctccgaacgcgcatcctgatcgtctgctgcgccttcggtcagcatgcgggccgcttctgttgccgcacggatagcaccatagcggcgctcaatcttctgtccatagcgatggatagcggatttgctgataacgtacccccgctcacgcagcagggactccagctcgttatacccgctgaagccggattcagtcagcgcccgttcaagccagcggcgcacgtcttccggcagcttttctattgtgctgcgtctggccattattcactccagtacttttccgggcgggcaatacccggaccacatttcacggtgtattccaccaggtctacgccgaggcgggtcaggtcagcaaaccagtcgccagaaggttttttctccagatcaaccattttacggtcagccagataatccagttcgcggcgcagttccagcggtgtggtgtccgggtagatggcacgggacacatccagcagcagcgtctcgctggcggtgtaagggcgggtcttgttcagggcaaccagcagactccagcgcagggattcgcggcgtacccgggtaatatcgaccattattgacctccggtattgcggtactgctgtaccacttccagtttgttataaagcgcgtccagtttggcctcaatgactgtctggccacggatataatcctctcgacggacataattcagcggtaaatccgctttaaatcgcataaattctttttccagctcgccccagttggaggcggattgttgcagggcctgttcaagggaggcgaatcgtgccgcctggcgttcttctgttttactgaacaaccatttggcgagccctcccacaaaccccatgaaggtgagcagaaaactcactaccgtccagaattcaacctgcagtgtcatttctgtaatccttcccgttcatccagtaacgcgtttatctggttccgccagcgacgacattgtcctgcgttgtcgatgatgttggcgagaacgtcacgctgggagacacccgaatcgcgtaaccgggtgtcagtggtttcaggttgcccggtcgctgtgccagagcgggtgccagcggcggcaactgagtctgaatgaccggtgtcgacggatgcattgtcatatccgagtgcggcgttgtactggcgcacgaaaccgcgagtaaacacgcactcaatgggatggctcttacctttttcatcaatccagcgctgtgtgacatcgttaatttgcccctgtagttgtttattccggctctccagttgagcaatctgctcaagataaccggcttcagcccgctgcccggcggccacctgctcctgataccgtctggcccaggcccgcagcgcagcattctcaagcgttgcctgctccgttttgtacgcgtcaaatgctgactgcaactgactgagcgcggtatcaccgtcacgctttgcagagtcatgaccacttctgtatcccatggcatacaggccgaccagaaaggcattgataagaatggccagcagaatgccgcgccacggcagctttttaaccagatgccacacaactgcagcctccccatgtgagatatcgcggtgccagttcgcgcaggatgcgctgcggataatggcggttctcccgccagctggccgcattgcgtccggcattcaccgtggcgacatgtccgaaccagcgggtgctgtccagacctttctgtgatgcaagccgcctgtcccgttgtacccagcccagaccaccgttatagcccgacaatgtcatggccatacgctcgcagtcgttggcggcgctgacgcgctgccacagccagcggtcatagctgaccagcgcccggatagcccatgcaggattaaacggctcacgattgctcagcatcggtatcaactggcttatccagtcggcagtggcaggcatgaactgcgccagtccctgagcgccagccggcgagaccacatcaggtcgccagccgctttcctgatgcagttgcgcggcgaaatcggccaccggcgcagacagtccccattcaagccgggcattacggatcacatcatcgcgatactgcagcgcagcctgcggaggctgcgctgcgcgggcctgactgaagaagccgccacaccagagcagccagacaatcaccaggttgccagcaagctgccaccagaagctgtatttatcgttacgtggttctccgtgtctgatggcggttacgcccagaccaaaggcgaacagaataatgagggtgatttgaggccagttcatggtcacagtcctgttgccacagccagacagaccgctgcaacaatcagtgcacggcggattaacgcagcagaaaatacaaggtgaaggccggtctgcacagggaaacgcccttcagccatcagtctgtcgtcatgtttcaggtactgaccgggacgggctttggggaagagcgaacggtcaagccagtaacccagcactgctgccagcgtgatgagtgccagcttgtagatcacaacaggcaactgctgtggcgagaccagagcgatgatgcccagcaacagcactgaggtcagcagccagccgctgaggcgaggttttttaacagggggaatgaattttttcaggtttttcatgtgtgtctcctcgtttggtggagacagcatcacaaatgtggcgggatacggattttaaacagcgttaatagtgaagatgtaaacgtgcactgcatgatggctttgaaagaacgaccagcccggtacccgaacaccgggctggccatcgccccacaggaatgcgctgtgagccgacacgaaacccctcttggaattccatacgacgatacagagctgtcagcatctcaaatgaaatcgccacgattaaacctcagtcatccacatttccctaaattcttcaggtacattacgtagggtgataatatttgtttccggatcataatcaatatagccttcagttttcccttcccggtcaaacttaagttcccaatatttagacttgcctttaaaagataccagagcccgaatgactcgaccatcaggaacgaagccatccgataactccaactcttcagcagcaagtttaccagataactcctcgggagcctggggccaaatggcattaacaagggtttcaagactaagtggttcaccagccttacttagtgcatgtaagtgttcaaacgcactcttaagaaatgcatctttttcagcgccgtcaagtcctttctctgccgcaaatgcttttaaaacgtcacgtaacttttcagactctcgtttggcgattaagacatcattacagcctaggaactgtgtgcgtcctgcatattttgcacaaatatcgtttataaggcgctgagaggcttcagtaactagaccttcttcaggactcaatctctcagaagcgtctccatttgaaagtgagttggggctggcataccggacatctgtgagaatgatgcaagcatcgacaaaatacttatccccggcgctgaaaccaaatgtgccaacgttggcacatttgggaaaagccaaacttttcgaattaatgacagaagacgacgaagagcttgccgaactggccgacggcggcacagttgccggcctgacgcttgacgacgttgatcgcatgtcagtacgcgaacttcgccaggccctgcgcgaagcgcgcgaaaccaacgcagcacaacagcgcgtactcgccgataaaaatgaaaaaattgattctctctctaccagactggaaaagaaatcccgtattcagccgcctgagcctgatgaggaggttaagaagctgcgggcggaagtgacagcattagcggttgaggcggaatctgctatcgccgttcgactgtccagcgcttttgagacactgtgcgcatattgagctgaaaacatgattgatacccccagagacttcatggcaggcctggtctgtcaactggaaagcacagcgcgtagcctgcgctccacatttgacctgccggacgagccaacaggcaatgcagcgccttcatggctgactgagccgacgccacagattaacgggctggaggcataaccaatgaatgctgccctgactgaacgactggtttatgtcgcccgcgcggcacgtgacgcggggcatggtaaacgcggtgcaatatacgacgctgcctgtgctgaacttggcatgtcccgcgccactctgctgcgcaggctgaaggaggtctctgtgactgataaacgcaaaaaacgcgccgatgccgggcgcagcgccctgacccgcgacgaagccgcgctgatatctgccacactgcgtgaggccacccgcaagaacggtaagcgtctctattccatcgcggatgcagtggaaaccctgcgggctaacggctttatctccgcaggcagaacagatgaaaccaccggtgagtttttcccgttgtccgaagatgccatcagccgtgccctgcgtaactatggcctgcacccggaacaactggatgcccctgcaccatatactgaagtggccagtctgcatcccaatcatgtctggcagattgatgcctcgctctgcacgctttactacctgagcaatggacataaagggctgcaggtgatggacagcgcgaagttctacaagaacaagcccgctaaccttgcccgtatcgccagtgaccgcgtgtggagttacgagattaccgaccatgccagcggctggatttacgttgagtatgtgacgggggcggaatccggtgagaacctgtgttctgtgcttatcaacgccatgcaggagcgtggcggcgcagacgtgttgcacggtgtgccgaaaatactctatctcgaccccggctcggcaaacaccgcgggtatgacgaaaaacatgtgtcgctcactgggcattgacctgatagcgcacaagccgcataacgcccgcgccaccggacaggtggaaaaggcgcgtgacattatcgaacgcaagctggagccgggtctgaagttccggccggttcacagtctggaagaactcaacgcgctggccgcgaaatggcgcagccactttaacgccacggctgttcacagccgccacggtaaaacccgcacggatatctggctgaagattactgctgagcagctgaaaaaagcgccttccgttgaggtatgtcgtgaactggctgtggcggcaccagaactccgcaaagtcacgccaaaacttcgtgtctcgttccggggcactgaatttgacgtatcaacggtaccgggcgtactggtcggtgaaaaactgatgattacccgtaacccgtggcgcagcgatgtggcacaggtggttctgaccggtgaggacggccacgagacgttcttcctggtcgaagaggtcagaaagaacgagtttggctttgctgaaggcgcggcggtatttggcgaaagttacaaagccctgccggaaaccccggcgcagatggcggcaaaagaaaccgaagcgctggtcaccggtacagacaacgccgcagatgcagctgccgcacgcaaggcgaaggcgctgccgttcggcgggcggcttgacccgtataaacatattgatgacgccacacttccggcctgtataccgaagcgaggtcaggcctctgacgtacgcggaccgcgcactgaacagcgtcccatgactcatgtggaggccgcgaaagccctgcgcgggaagttcagcgccaacggccttacctggacgccggaacattaccgccagttaacggcacagtatccggacggcgtaccggaagccgcactggatgaagtcatggctacgctgaccacgccggcccgcagcagcgttatcagcattgttaacggcaactgaggagggaaacatgctggtactgaagcagcaactgaaagaggcccgtattccacaggcggtggtggcgagagctgtcgatgtttctgaggccacgctggcccagattgtgaatcataacgcgtggccccgcaccagccccggagaagtgcgccggcgtcttgcgtcctggctggaaagtcaggggattgatacagcgaagagttttgatgctgtacagggcgcggccacgccccgtacagcgggtaccacagataaaacgagcctcagtgaggaagagaatatgttactcaaaaaacaggtgttatttccagcaaccaaaaaagcgtttggtcttttccgtgacccgttcgccgacgaagccatgcagggttctgatgatgtgttcaccacaccagacattcgctacgtgcgtgaggcgttgtaccagacagcccgtcatggtgggtttatggccgtcatcggtgagtccggtgcgggtaaatccacgctgcgccgtgacctgactgaacgtatcaaccgcgagaatgcgccagtgattgttatcgagccatacatcatcgctatggaagacaacgatgtgaaagggaaaactctgaaggcagcagcgattgccgaagccattatcagtaccatcgcaccactggaaagcatcagacgcagtcaggacgcccgctttcgccagttgcatcgcgtcctgaaagacagcaaccaggcggggttcagccacgttctggtgattgaggaggctcacagtttgcccattccgacactgaaacacctcaaacgcttttttgagctggagtccggtttcaaaaagctgctgtccatcgtgctgattggccagccggaactggcgacaaaactctctgaacgcaacatggaagtccgcgaagtcgttcagcgctgtgaggtggtcgaacttctgcctctggacaatcaccttgaagaatttctgacgttcaaactgcaacgggccggtaaacaactgacggacattatggacgccagcgcagtggatgccatacgtacccgcctgagcaatccgggaagtcatcgtaaaaatatggtcagcctgctgtatccgctggccgtcagtaacctggtaatagccgccatgaatctggccgctgaaatcggggttccacaggtcaacgctgacgttgtcaaaggggtttaataatgaaatccaccacaggtatcaaccagcaaatcagtaaagtgcagtcagccattatggcgcttaaggcgacgaacacggatgtacaaagcatcaccatcaggggtaacaaacctgtcatccgcgtttccaggagtgcgcattgcatgcgcatgcttgagcagggaaaggcctgttatctgtataccggacatgaccacaggggatatttccgtcagggcgttttcgaactgcacggctgtcgcgtcgtgtggccggaatctttgtggtaatcagcacaactggagaaatcataaaaaatggcaaaaagtacaaaaggtgcaaaacgtatcaaggccgcagcagcactctgggtgccggggacacgtgaagaggtcattgagggcatcagactgctcggtgacgcacaccgtgaactggtcagggctgaaacagaaatgaatgacgccattggcgatatcaccgcacgttatgccccgctcaccgagagcctgaaaaaacgcatggccgaactgcagtccggtattcagacatggtgtgaggcacaccgtgatgaactgaccggcaacgggaaggtgaagtttgctaacctcaccaccggcgaggtgcagtggcgaaaccgcccgccgtcagtcagcattcgcggagcggataatgttattgaactactgagacgtctggggcttgagcgctttattcgtgtaaaagaggaaataaataaagacgctatcctgaatgaaaaagaggccgtgaaaaatattcccggtatttccattaaaagcgacattgaggatttttcaataattccttttgagcaggatgtgcagtaaacacaccacgttaattatttaataaaaacattttcttttttattccggcgtcagcgccgtgggcttctgcacgctggaaacagaggagaattaaattatgatatttaaatgtattcagtgcgagagggatataacagccctgcgttttcacagcgccatcgccgtgatgtccggtaaataccacatccctgcggtacgcgtcaccctggtctgcccgtactgcagccagcatttttcggcagacgtgcctgtcatggaattctcccgccctgacagggaggacgcgcaatgattaccccacaggaagcacgccagcgtacccgcgcccttgttgaacactatgtcaacgagtgtgaatgccgcgacctcaccgatgtgaagcacgtcctgacggcgctaatcagcatggccacgcaggccattgtggcgaccaacggaaaggcggctgcactgcaggtactggtgaacacactcacccacacggcagagaacgaggtgccgtaccggatggaaaccactgcagaaggcggcctgcacatcaccgtcagccggaagcactgagggcgcggcatgacacggaacaccgaactcacccgcaccgccctctaccgtctggccctgcagcgtttcgggccggacgcacaggccctgaaactgacagaagaggccgctgaactggcggccagtgccgcccgcaacctgaacggacagggcagcgaaagtgacctcgcggcagagctggcagacgtggaaatcatgacagagcagctgcgccttcagggaatggaccggctgattgacttccacaaacagaaaaaactggaacgccttgccgcacggctgggcgtcacatacaccggagaaatcatatgaaccgcaccgaacagacgccacaactgacgccggaagatgctgcacagcgtattcgggtactggaagacgaaaacgaatacctgcgcaagagatttgaagaggtggacctgtacttcgggcgcaatctggtcgtcatgaaagctgcagtgattgagtggcgggccaccggtgatgccaggaacggcatggcgtggatttacaacaccctgtgtgggccgggcgaactgccgccgcaagaggagaaagaggcacaggaatacttcaacagggaaactgaagttatcgacagaaaactggctgccctgtaccactggttcaggaaataccacaggacacacgccgcacctgaccagaccaccacaggaggtaccagtgactgacaccattatggaaattgtggtatgggctttcctgcttactggtatagccgtgtgcatctgcgccggattcgccctggttgccctgctgacccacgtggtgacgcagtggttatgggaaaagcttaaagcagcatacagcctgaaagagctgtccgacgctgttcgggcatgggaacagcaaaaaaataccggagatactgaacaatgacagaccaggataagcacattgagaaactgaaaaagttgctggcgctggcagcatccggcaacccgcatgaggctgctctggcactgcgccgcgcccgtaaactgatggatgttcacggcatcacacattccgacatcgccatgagtgatattgatgaaaccatcagtcactactggccgacaggcagcctccgtccgccgcgctacatgctgggcctgatgaacatcatccgcgaggcatttggtgttaactccatcattcaccccggcacatatccgggtgtggggttctacggcaaccgggaacgggccgcactggccgcgtacacctgggaagtgctggcccgtcagctgaaaaaggcgcgtcagcagtatatcagtgcacagaacaaaagaataaaaaccgccacccgcaccagccgtggagaccagtttgctgaaggctgggtgctggccgttatcagtgaaatacagtccttcgccctgaccgatgacgaacgtgaactgatgcagcagtggctggaacataaatacccgcagacgcaaaccaccagggcgcgtaaaccgggaagaagtcgcaatggcgacgcctcgcgctatgcggggtttcgagaagggcagaacgtcagactgcaccgaccggtcagtgggcgggaacagcagaaactggaggccagatgattacgttatcaggtaacagccggaaattaaaagcctgccgaatatctgccagatacctttttgcccgcgccttttttaagaacgtcaggccggggatcacaattggtgttattgccggacgcgaacaggttgaaaaatacatgtcaggtgcatggtggaataaagaccctgtcattgctgcccgtaatattcatatcagttggggggatattcagaatgacgactgaatctgttgtatgtgccctgttctggtattgttttgtcggttggtgtactgctgaactgcaccgccgttcagggttttattcacgttacagtggtgccggttactggattagctggtcggtgatgttcctgtgctggcctgtggcacttcctttatatgtcgattatatcggtgatgcaggcagaaggagcaacaatgatgactaaacaacgtcttatccagctcattcatattgcccgtaatgaactgggtatggatgaagacacctaccgccagatgttacaggggctgaccggtaaagcctcaaccaaaggaatggataccacacaactaaactgcgtgctggaatccatgaaaaggaaaggctttcgcgttaggcctgcaggaaaagccagctccggtttaccgctggataaccatccgcaatccaggaaaatccgtgcgctatggcttgaaatggctgctgccggcattgttcgtgaccgttcagaaaatgcattagcgcggtggatcaagcgggaaacgggcatcagcgccctgcgctggctcaatactgaacaggcaagcagtgttattgagaaactgaagaagtggcagcgcagagctgcgggagtaaaacatgagcgacctgaatcagtttcgaagtaaagggccggaactcctggtggaactggcacagcatacctctgagaccgttcgcgagattattgatattgagcccgcaattgccgaccagattggtcaggccgtcgcgaaccgcatgatgcaggtctggggcgggcaaaacgtttatttcccgatgggcatggtatggaaggtcagtcagcgcgaccgggaaatcttcagggagtttaacggacgtaaccaccatgaactggcccgcaaatttggtgtttcgcttcagtgggtctacagcgtggttaagcgggtaagaaaagaagaactggatcggatgcagggcaagctatttgctgatgaacccgatgtagatacggagaaaaaagagtaatatctgcaatcaggctggcgcgagttctgtttttgttcgggccggtctgattttcacatactgtaaggttattgcatattcctcctggtctcttcccattttgacccagttcttcccataaatatctcacttattccctgtcatttatctcaagtctaatcacctgatggcgacgcgcgccttatttatagaggtcggcgctgatggtgatgttattaccgcgctcctgccactgacgcgtaatatgataatacttagcgcctttcttcgccgcgcgtttggcgacctggtaggagatttctgtcatattgccgtagttgccggtgaacttaacgctgtcgaaaggcaccatcatcgcagccgtcgctttattcagctcctcaacttttgtgccatccggaagtgtgacagtgtaacgcccgcctttggaggattgcgtttcgaagaaacggcctacttcggcgctcggcgaggctgacgtggcgacgcctggaatttcgactttcttcgcagcttcgccgccctgagccagcgcggcacggccagcttcagagtctgccggaatagcgtccgggctctggacgatgcgttttttcgcatcttgtttatagataaatacagtgatgcgttggtttccgccctgattcgcatctatctgacgaacaatatagaaagcgtatgcgcctttttgtttcgccgctttcgtaatggcatcgttaacttccggctggctacggtagaagccctgaacggtgacggtgtcatacggttctaattgtacggcctggtctttcggtaattccacgatgccattaatgacacgatttttgggcgcgtcggctttcggcgcgtcggctttatacacgtccgccacaacacgccagttaccactgttgccgaactccgaggtgtcgacaacatagaaggaggctgcgccttctttatctgcgcggcgggacacggcggagaccgcatcgccaatagcattaaaacgaccggtaataacgatgcggtcataaggttttagtgcagccgcttgctccggcgtcagttctgttgctgcatggacagaaaaagcagccgcagaaagcagagccgacgccaggagagtgttcttaagcttcataaaaataatcctttgccttgcgcaaaccaggtactggtattgttattgactagaaacgtggctgattattgcatttaaaccatatggatgtctgcgggatttttcacgcatcgtgtcatgtatcctatctttgatgataacatttactgatatgtcgaaaaaaacggcgtccgggcggctaagctaatgaagcgcataaatttaataagttaatttaatgttaatttcttgatctcgccaggggtttaatgatgttttgctgtcaaatttgagcgaattatcagccctcgcaggccattttcaaggcattatggctgcttagcggctgaatcgttcatgttttgtaaatttgataaaaaattctgttttttggcgctagatcacaggcgttattttcagtaggttatagagagtttgtaacggttttattctgctggggtaacatttacctcaaacgcgggcaggcgtacgcttctcgcgcttactgacaaaccatcatcaaaaataccgatggaagggaacatttatgcgaattggcataccaaaagagcggttacccaatgaaacccgtgtcgctgcgacgccgaaaacggtagagcagctactgaagctggggtttagcgtcgctatcgaaagcggggcgggtcaactggcaagttttgacgacaaagcgtttgcgcaggctggcgcggatattgtagacggcaatgctatctggcaatcggaaattattctcaaggttaatgcgcctgaagaagaggaaatcgctttactgaaccccgggactacgctggtcagttttatctggcctgcgcaaaatcctgggttaatggagaaacttgccgaacgtaaggttacggtgatggcgatggactccgtgccgcgtatttcccgcgcgcagtcgctcgacgcgttaagctcaatggcgaatatcgcgggttatcgcgccattgtagaggccgcgcatgaatttgggcgcttctttaccgggcaaatcactgccgccgggaaagtgccgccggcgaaggtgatggtgattggcgcgggcgttgccggtcttgcggctatcggcgcggcaaacagcctgggggcgattgtccgcgcgtttgacactcgtcctgaagtcaaagagcaggtccagagtatgggggctgagttcctcgaactggattttaaagaggaagccggtagcggcgatggttacgccaaagtgatgtccgaggcgtttatcaaagcggaaatggcgctctttgccgcccaggccaaagaagtcgatatcattgttaccaccgcgttgattccgggcaaacctgcgccgaagctgattacccgcgatatggtcgattctatgaaggccggcagcgtgattgtcgacctggccgcgcagaacggcggtaactgcgaatataccgtcgccaatcaggttgtgacgacggacaatggcgtaaaagtgattggctacaccgatctaccggggcgtttgccgacgcagtcatcccagctttatggcaccaacctggttaacctgctgaagctgctgtgcaaagagaaagacggcaatattgacgtggattttgacgatgtcgtgatccgtggcgtgacggtgattcgtgacggcgacattacctggcctgcgccgccaatccaggtttccgcgcagccacaggccgcgcctaaagcagcacctgcgccaaaagagccggaaaagcccgcttccccctggcggaagtatgcgttaatggcgctggcgatcattctttttggctggctggccgatgtcgcgccaaaagagttcctcggccattttaccgtgtttgcgctcgcctgcgtggttggttattacgtggtgtggaacgtgtctcatgcgcttcatacgccattaatgtcggtgaccaacgcaatttcagggattattgttgtcggggcattattgcaaattggtcagggcggctgggtcagcttcctgagctttatcgcggtgcttatcgccagcattaatattttcggtggcttcaccgtgactcagcgtatgctgaaaatgttccggaaaaactaaggggtaacacatgtctggaggattagttacagctgcatacattgttgccgcgatcctgtttattttcagtcttgccgggctttcaaagcatgaaacgtcccgccaggggaataacttcggtattgccgggatggcgatcgcgttgctggcgaccattttcgggccggataccggcaacgtggcatggattctggtcgccatgattattggcggcgcgattggcatccgcatggcgaaaaaagttgagatgaccgagatgccggagctggtcgcgattctgcacagtttcgtgggcctggcggcggtactggttggctttaacagctatctgtaccatgacgccagtctggcgccggtgctggtgaatatccatctgaccgaagtcttcctcggtatctttattggcgcagtcactttcactggatcgatcgtagcgtttggtaaactgcgcggcaaaatctcttctaagccgttgatgttgcctaaccgtcacaaaatgaatctggcggcgctggttgtttctttcctgttgctgctggtttttgttcgtaccgaaagcgtgggtctacaggttctggcgctactgctgatgaccattatcgcgctggcgtttggttggcatctggtcgcttctatcggcggggcggacatgccggtggttgtttcaatgctgaactcctattccggttgggctgccgcggcggctggcttcatgttgagcaacgatttgctgattgtgaccggcgcgctggtcggttcgtcaggcgcgatcctgtcttacattatgtgtaaagcgatgaaccgctctttcatcagcgttattgctggtgggttcggtactgacggctcctcaacgggcgacgatcaggaagctggcgaacatcgcgaaattacggcggaagagaccgctgagatgctgaaaaactcccactccgtcattattacgccggggtacgggatggcggtagcgcaggcgcagtatccggtggcggaaatcaccgaaaaactgcgtgcgcgcggtatcaacgtgcgtttcggcattcatccggtggcgggtcgcctgccggggcatatgaacgtgctgttggcggaggcgaaagtgccttatgacatcgtgctggaaatggacgaaatcaatgatgatttcgccgataccgataccgtgctggtgattggcgcgaacgatacggtgaacccggcggcgcaagacgatccccgcagcccgatcgccggtatgccggttctcgaagtgtggaaagcacagaatgtcgtggtctttaagcgttccatgaatactggttatgctggtgtgcagaacccgctgttctttaaagagaatacgcaaatgctgtttggcgatgccaaagccagcgtggatgcaattctgaaagcgctttaatcttttaaacgtgcggcggcctctttggaggccgtttttatacatttcaccctataagctgcctctttgttggctgcgctcagaaaccccggtcacatcgttatctatgctcccggggatttcttcccttgccgccgcgatgcatcttgaatgattttgtgtatatattgcattttatcttttgtttaaatcgctaagcagaacggcgatactctgcccgccggtggtctgttcgagggcgattttgacaatgatggttaacggaacggagagcaacatgcccaccggacctaatagccagccccagaaaattaacgacaaaaataccactaaggttgaaaggcctaaaccacgtcccatgatacgtggctcaaggatattgccgaagaccagattaatcagcagatagcccgccagcaccagcagcgcatcataaaacccgttaaataccagcacctgaataatgggcggcagggcagcgagcaccgatccaatattagggatatagttcagcgcgaaggccagtagaccccagacaaaggcgaagcggacatccagagcggccagcattccccatgcgaccagtcccgtcacgatactgatcgctgtttttagcaccagataatgtgaaacgctatcaagcgcgcgttgaattgccgccataccttctaccggacggctcatcatctgctgcagtttttcaggcagttgtggaacctccagcagcatgaataccacggtcaataacaataaaaagatggatgacatggcattggacagttgggtgagcaggttcgttaccagagtcatggcggcgtttggatcgatatatttcgccagctcatcaaccgacacgccaatgcctgctcgctgcaaccacggttcaatacgttgcaacggtatcaccaatgaggagcgatactgcggtagggtacgggccagttcatttaatgatgtccccaaataggccagtagcagtaccattaacataacaataatcacaatgagcaatgatacggcgataacgcgcggaattcgacatcgggtcatccgttgcacaacgggattgagaacgactgcaataaataacgccaaaataaagggaacaatgatatctgcggcgaagcggataccgctcagaataaccaccagcattcccagcataatgacgatttttagaccattgagcgtgatgatcggttttgccatatcagtccctgttttctatgccgacacgaataataatgtgatgtcggtcgacctgttctggttaaaatcaaacacttcaggtaaagaagtgaaaatattttgagttaattcctggcttatgatacaaatcaggcgtgttcaactaccgaggacaattatcatccgcgatgacgagaagcaacactgcggataattgtaatattatggacaatatgttcagcgcttttttctccacgcaaacgcatcttcactctacctcctttttcctgcttatcggcgagcagcactggcgtaacgcactttagtctctcacttctgcctgagctggcgcaatgcgctgtgctaactgattttattttttagtttgctgcgtgcagcagactcgaaagagtatattctcatgcaggagaagtgtcatgttttactggattttattagctctggctatcgcgactgaaattaccggcacgctctcaatgaaatgggctagcgtgggtaatggcaatgcgggttttattttaatgctggtgatgatcacgctgtcatatatatttctttcttttgcggtaaaaaagattgccctgggtgtagcgtatgccttatgggaagggatcggcattttatttattaccatttttagcgtgctgctatttgatgaagcattatcaaccatgaagattgccggcttgctgacgctggtcgccggcatcgtattgatcaaatcagggacgcgtaaacccggcaaaccggtgaaggaggcgactcgtgcaacaatttgaatggatacacggcgcctggcttgggctggcaataatgctggaaatcgcggctaacgttctgttgaaattttcggacggctttcgccgtaaatgctatggcatcttatcgcttgccgctgttctggccgccttcagcgcgctttcccaggcggtaaaagggatagacctgtcggtggcgtatgcgctatggggcggttttggtattgccgccacgctggcggcgggctgggtgctcttcggccagcgcttaaatcccaaaggctgggttggcgtgatattgctgctcgccggaatggtcatgataaaatttgcctgagacgatcgctgccggtcaggcagcgattcccgcattaatcctgcgccagagctttcagcttatcgcgaaagccggtgacggatatagcgcggttatcggcgcgccagcgatctttagccgcaggggcggagctttgtacgccaatgagctgccatccgctatccgtgtgcaataataacggcgagccgctgtcgccaggtaacgtgtcgcactggtgtgagagtacggcattctgcgcccagccggtcacgacgcaatcctgatgggaatagagcgcattcagatgatcttccggataaccggactgcgtgacttttcggtctgcggctttcaacgccgcagtgagcgccgctttatcgccggtaaataaaggtactggcgtgataccggaaggtgggtagcgcaatattaccagaccaaaatcccagcttgccgcggcaggcggcacaatccagccatcgccatccgctttcaaacgtcggcccagcgacggttcaacgcggccttcaatgccgtggatttcatagcgccatactccttttcgcgccacaaaacgcagcgcaaccgctttgtccggttttcctttcggcggcgttagcaggcagtgacctgctgtcagggcgatatgcggggagataagcgttgccgtacacaaattaccgctggcggtctctagttgcccgatggcatcccacggcgattgggttggatcggcgacgggcactcgatcgtcatggttaaaaaaaagcgttttgacgtcgctggcatccgtggcgtctgtttcagcccccccggctttcgccataaccggtaaaaaacacactatgcccagtaatacagcaatggttttatgcatatcacactctggtgggtaattatgattattaacaacaaaccctcagtactactatagacgtgacggtaagaaagtgggagtaaaatcagataactacactcaggaaagatagaaatgcgtggcaataacggcgcataaaataagcacgataagaatgagctcaaagcggtagcgagacacttttttgccctcccggaaggcggcgctaaaccagaacgatttagcgccgtaaaaacgggcgcgggggcgcgccgcagcatgttacgacttacgcagctggttgcgaagttgtttttgacgtagatttggctggggcttttttgccatcttttttctggtgctttttagccgcctgcgctttttgctcaacggtttttttatgctgttttttgtggtgctgggtggtctgggttgttttggcaggcgctgcggtttttgcaggcgttgcagtctcagccgcgaatgctgcggaagagagacccattgcagcggcaacaaccagagctaatacttttttcattttgataccctcgatttggttttcattcaaccccactgcggggccggtgaaatgactatatcgctgttatcaaaaggcttccgtgagtgattggtttcggcatgtaacgctatgtacaatcccccggtaacgcgatgtaagcccccaccataataggtagctttacgttaccggccgttatttttggtcgcagagtcggtaatatccgccctccagaataacaggcacaccgtatatgaatccgataatctgggtggtatttacgcttctggcgctggatgcaatcagagaagtcatgggcgtatcaagcctggcaggtctgtggtgaacagtgagtcgtggcgtgaaaccagcccggcgatagcgcacgttgctatcgccggattattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttatttcttttcaggcgtgaagacgatgatgtagccgcgtcccgaccaggatggccagcaccagcattagcgcgataaaaccacctacgccgttccagccgtaactatgccagaatacaccgcctagcgtcccggcaatactggaccccagataatagctgaaaagataaagtgacgaggcctgtcccttcgcccggcgcgcacgcgggccaatccagctactggccacggagtgcgcggcgaaaaagccggcggaaaaaagcagcatcccggcaaaaatcagccaaagcgaggtaaaaagcgtcagtaaaagcccgcccagcattactgcggtagagaacagcatcaccggcccccggccatagcgtgaggtcattgcgccagctttcggcgagctccatgtgccggtgagataggctacggataacagtccgaccacggcctggcttaattcccagggggagagcatcaggcgataaccaatgtagttaaacagggtgacgaacgcgcccatcagtaaaaaaccttccgcaaacagcagtggtaaccctcgatcgcgccagtggagacggaaattaataaatagcgttttaggccgtagcgacgtgggacggaaatgttgcgaggcaggtaaaatcttccagaacatcagcgcggacgccagcgcaaagcatccgatggccgccagcgcgatgcgccagttaaaaaagtcggtcatgacgccgcttaataaacgcccgctcatcccgccgatggaattaccgctaatatagagccccatagagaaagcgacaaagctgggatggatttcttcgctcaggtaggtcattcccaccgcggcgacgccgcttaacgacagaccgatcagcgcgcgcataatcagaataccatgccagctggtcatcatggttgataacaatgtgcagcaggaggctaataacaaggcggtgaccatcaccggtttacggcctatcgcatcagaaagcgggccggtaaaaagtaagccgatagccagcatggcggtagaaatagaaagtgaaacgctgctgctggcgggggagacgccaaactcctgggaaagtaccggtagtataggctgaacgcaataaaggagtgcgaaagtcgccaggcccgcggaaaaaagagccagcgtgacgcgcatgaaaggcgctgtaccgcgtttaataaattgaaccggctgagaatggcgttgttcatcgatatcgctcgccgtggcgtcatcgagaatagttgtacgactcacgttaaatccttgctttacatctccgtcaacaggagacgggtataaccgacatgtaaagcatagaaaaagcaaaatattctgtctaatatattaattgtctcaaataagacgttaaaaatatgaatatcgaattacgtcatttacgttactttgtggcggtagcagaagagctgcattttggtcgcgccgccgcgcgcctcaatatctcgcagccgccgctcagtcagcagatacaaattctggagcagcaggtcggtgcgcgattactggcgcggaccaaccgcagcgtagcgttaaccgccgccgggcgacagtttctggcggatagccgacacatcctgagtctggtaaacgacgccgccgctcgcgccgagcggttgcatcagggcgaagcgggcgaaatccgtattggttttacgtcttcagcgccttttattcgggcggtatcgcataccttttcgttgttccgccagtcctatccgggggtgcatatgcaaacgcgtgaaatgaatacgcgtgagcaaatcgcgccgctcaacgaaggcgtactggatattggcttgctgcggaatacgccgctgccagacacacttaatcgcgaggtgattttgcatgagccgcttatggccatgatcccgcgcgaacatcggctggcgcaaaagccagtcgtcagtctgacagaactggcggaagaacctttcgtctttttcgatccgcatgtcgggacgggtctctacgacgatattctcggcctgatgcggcgctataacctgtcgccgaccatcacgcaggaggttggcgaggcaatgactattatcggtctggtggcggcgggactgggcgtctcgattctgccggcatcctttaagcgtgtacagatgagcgagatgcgctgggttcccctggcagaagaggacgccgtatctgaaatgtggctggtatggccaaagcatcatgaacagagtcatgccgtacagcggttttgccaactgctattactggctgcccgacaggattaattacgcttaaaaagggtgaaaatgtgcagttaatcacacggctaagcaaaaagttgacggcgagtattgaagtgtttcaccatagcacacagattatttcggagcgcgaaaataaagggagtgagcggtggttgctgatagtcagcctgggcatatcgatcaaattaagcagaccaatgctggcgcagtgtatcgcctgattgatcagctcggaccggtatcgcgaattgacctgtctcgtctggcgcagttggcgcctgccagtattacgaaaattgttcgcgaaatgctggaagcgcatttggttcaggaacttgaaattaaagaggcgggcagtcgtggacgtcccgccgtcgggctgatggtggaaacggaagcctggcactatttatctattcgtattagccgtggcgaaattttccttgcactgcgcgatcttagcagcaaactggtggtagaagagtgtctggcgctgccgttaaacgaagctacgccgttgcttgagcgaattattacgcacgttgatcggttttttacccgccatcagcagaaactggagcgtttgacctccattgccattacgttaccgggcattatcgataccgaaaacggtgttgtgcaccggatgccgtattacgaagatgtcaaagagatgcctttgggagatgcgctggagcggcacaccggcgtaccggtttacattcagcatgatattagcgcctggacgatggcagaggcgctttttggcgcctcacgcggcgcgcgcgacgttatccaggtggtgattgatcataatgtgggggcgggcgttatcaccgacggtcatttgcttcatgcgggcagtagcagtctggtagagattgggcatacccaggtcaatccttatggtaagcgctgttattgcggtaatcatggctgtctggagaccatcgccagcgtcgatagtgtgctggaacttacgcagcttcggcttaatcagtcgataagttcaatgttgcatggccagccgttaacggtagattcgctgtgtcaggcggcgatgcagggagatctattagcaaaagatattattagcggcgttggcgcgcatgtcggacgcattctggctatcatggtgaatttatttaatccgcaaaaaattcttattggttcgccgctaagtaaagcggctgatattctttttccggccattgctgacagtatccgtcagcaggcgctgcccgcctacagtaggaatacggtagtggaaagcacgcagtttaccaaccagagcacgatggccggggcggcgttggtaaaagacgcgatgtataacggctctttgttgattcgtctattacagggttaacattttttaactgttgtacaaaaatttgcgctaactcaagctgattgcccttgccatatcttagactttctccactgtattattttcctggcttatattttcgaagcataacggtggagttagtgatgctgaagcgtttctttattacaggtacagacacttctgttgggaagacggtggtttcccgcgcattactacaagcgttatcgtcgggtggtaagagcgttgcagggtataaacctgtcgctaaagggagcaaagagactccagaagggatgcgcaacaaagacgctctggtattgcaaagcgtctcttcgctggagttgccgtatgaggcgattaatccgatcgcgttaagcgaagaagaaagcagcgtcgcgcatagctgtcctataaattacaccttgctgtccaacggtctggcgagtctgagcgataaagtggaccacgtggttgtggagggcactggtggctggcgtagtttgatgaatgatttacgtccattgtccgaatgggtggtacaggaacagttaccggtattgatggtggtggggattcaggaggggtgcattaatcatgcgctactgactgcgcaagctgtcgctaatgatggactgcccttaattggctgggtggcgaatcgtatcaatcctggcctggcgcattatgctgaaattattgatgtgcttgggaaaaaactgccagcgccgctgattggcgagttaccgtacctgccgcgcgccgagcagcgtgagctggggcagtatattcgtttgtcaatgctcggcagcgtgctggcggtagatagaatcatggcgtaacgttcgcgagagcactgacgcgactacacaggcaatcagcagaccggggagtaactgatactcgccggtcatttcacaaatcatcagggtggacattatcggcgcatgagttgtcgccgccagtagcgtcgccatacccgccagccccaataaaatcgctatttcatccgagcctggcagccagaatccccatatccgacccagaaacattccaatggataatccgacaaataatgttggcgtaaagacgccgcccggcgcgccagacccgctgctggcgagcaccgccaggattttgcacgcaaaaattccgccaatcagcgagaatagcggcggggagagcaaaaatgattgtacgacgctatagccgtttccccataccgtgggcgtgagtaacgacagtaatccgacaataagcccgcccaacgccagttgccagggcggggacagttttaagcgtaagaaactattatggctggccgtcatcagccacatcagcaacggaccccacagaccggcgaccagaccggtactgactatcatgacgtactcccgcgcgtagagatcaacggtcagatgtacggtatagagtagtgaatcgctaccgtttaatacatgggtggttagcagggcgacgacggcggaaacgacaaccgggccgagggaagccagcattaaggtaccgaacaggatctccgcgataaacaggctgcccgccagcggcgcatggtaagcgcccgccatgcccgcagcggcgccgctggcgatccataatttccattcctcacgcggcgtgaagcgtcgggcaaagctggacgccgccagcgcggcgaggaggatcattgcgccttcgcgaccaattgcgctgccgctgaccacgaccagcagcgaggccagcgatttcaccagactggcgccaacgtcaaattgcccgtcggtttgcaatgcttccatatagtcagtgggcgcatgggggcgctgttggttcattttttgccacccccacagcaacagaccagcggccaggccgccaagcgccggcgtaatcagccgtcgccagggcgaaagcccctcagccgcattcaccagactgccggtgtcattactcaggaaaatccactccagcaattgcatcgcatgacggaaggcggcgacagccagcgccgcgagaataccgatgagcgtagcgatcagcaggcgacgaaacatcgcgcgcagatccgggtaagcgtgtaaacgatgcatgagcgggtaaacagggagtttcaggatagcctattctgcggggaaatggcgtcagacgcaaaagcactatgtgcgatataatattgcgtacaataatgatactgccggatagcgagaggcgatccggcggcaacgttagctgctttcgtgaatatttagcgcccgacgagtgcggcctgagctgagataatcggcgatgtaatcctgagagatttcaccgttatagcgtccgtcttcatcaacgatcggcatccagctggtattactttcgtacaatctggacagcacaatacgcagattatcttccgctttgcccgtaatacggaaaggatgggtgatatcggcgcagattccgctggcgttccgcgcctcccggcgcttcacaaatcccagtggcttaccgtcgttgtcaatgacggtaatggcgcgaatatcgtgatcatccataatgccgaacgcctcgcttaacggcatggaaggccgcgcggtaatggttggctgttggtcggtcacatcgcctgcggagaccagtagcaaacgctttaacgttctgtcctgaccgacaaacgacccgacaaactcgttagccggcttggccagcagttcatcaggactggcgcactgtacaattcgcccctgacggaacacggcgatacggtcgccgagttttagcgcttcgtcgatatcatggctgaccagcatcacggtcttttttagcttacgctgcatatccagaaactggttctggatcacttcgcggttaatggggtccaccgcgccgaagggctcatccatcagcagtaccggcggatcggcggccagagcgcggatcacgccaatacgctgttgctgtcccccggacatctcctttggatagcgatgcagaaattttctggcatccagcgccaccatgtccatcaactcttcggcgcgttgcttgcagcgcgctttgtcccaacccaacatgcgcggcacaacggtaatattttcttcaatcgtcatattaggaaacaggccgatctgttggataacatacccaatattgcggcgtagcgttaccgtatccatatcgttggtattctcgccgttgataagaatattaccgctgctgggcgcgatcagccggttgatcatctttaacgtggtggttttgccgcagccggagggaccgagtaagacgcacatttcgccttccggcacgttcaggttgacgttgtcgacggcttttagcggctgaccctttttctgtacaaattgtttggtgagattttccagttttatcattatcgtatccccttaggtgccagtacgacttgcagacgatgcaacagccagtcaagtacaattgccagtagacagatcatcagcgcgccggcaattaacatgcgaatatcgctgccgctaatgccgtttaacagtagcagccccagaccgccggcgccgatcaccgcggcaatcgccatcacgccgatattcatcactaccgcggtgcggatacccccgaaaataaccggtagggccattgggatttcgacccagcgcagccgttgccagaaagtcataccgatgccgcgtcccgcttcacgcagaccgggcggcaaactatcaagcgcagtatgggtattccggacaatcggcagtaaagagtagagaaaaacggccgtcacagcgggcagaacgccaataccatgcccgatcagcgaaaagagcgggatcattaatccaaacagcgcgatagacggaatggtaagaagtagcgtggcggcgcccaataccggcgttgccagccatttgtggcgtacaatcaaaacgcctaacggtacgccgatgataatcgccagaccgacggccagcgcgactagccagagatgctgaaaggtaaggctggcgagatagcctgcgttatccagcatataatgtatcgtatccataggcgctccttacagcagacctttgtcctgcaaaaattgatgggctacctgttgcggcgtgcgatgctcgatatcgacctgggcgtttagggtcgatatcacatcgttattgagcaggccggaaagggtgtttaaggcgtcatcaagaccaggattggcttccagcacctctttacgcaccacgggcgtgacagcgtaacttggaaagaagcctttatcatcttccaacactttcagatcaaaccctttcacccgtccgtcggtggtatagaccagcccggcgtcaaccagtccatcccgaacggcgttatagaccagccctgggtccatctgtcgtatttgcgggcgatcgagctgcatctggtaggcttgctgaaggggcttcatcccgtcgctgcgcccggcaaattccagatcgaggccgagcatccagttgtggtcaggatcgttctgccggacttgttcgatttttgccaccatttgcgagatggtggtgatattttccgactcggcgcgtttacgctgcatcgcgaacgcgtaagtattgttcatgtcagccggtttgagccataccaggcccagcttcgcatccaggcgttttaccgtgtcgtaggtttcctgtggactcatgcgcttatcgatacggttgaaaataatcagcgatgtaccggtatattcccaggtaatatcaatttgtttattcaccatcgcattacgtgaaatcaccgcggcgatattggtttgcggctgaacctgaaagcctttcttctgcaaatactgaacggtcatagcggaaagaatatgctgctcggtaaagcttttggtggcgagaaccagcggcgcggcctgcgtctggctactgaacaacagcgttgtggcaagccatcccaacaggtgttttttgaatctcatttaacgctccttattgttatttatgcgttcagacggtatgagggctaaggcgtcgcccaaaccaggcaagcagagtgtcaagaatcagcgcgaataacgccgtggccgttgcgccgagaatcaacgtcggaaaatcgttgagataaatccccggaaaaatcagctcgccgtagctgctggcgccgatcagaaaggccagcggcgcggtgccgacattgatggcggtcgcgatgcgaataccggacagcatcactggccacgcattaggtagctctacctggcgaagccgctgccattttgtcatcccaatcccgttcgccgcttcaatcagtgaggcgggaacggaacagaggcctgcataggtattgcggacgataggcagaagagaagccagaaatagcgcgacaatggcgggcgtatcgccgatcccgataatcaccatcgctaaggccaggacggccagtggcggcaaggtattaccaacattaaagatttgcatgacatattcagcaaatccttttgccgcaggtcggctgagtaaaatcccgctcgggataccgaccagtaaagcaaaaaacatggacgtaaagaccagcatcaaatgccgttgtccgagatacagcagatcgacctgacgcgctttcagcgtctccagaccgattccccagataaacagcgccagtaacagcagaatgacgatagtgaacccaagtacgcgttttagggtgaggatgtgcattgcggtgtgtctccctgtttgcatgtgttatggcgacgttaagagtcgcgtgttgttatgccatgttccggcagggtgctttgagctatagcaacaggttgggaaggattccagcggagcgtgatgtttaacactgttaaacatctattaacaattatgttttgcccttatgcggcttagcgtgaacattcacgataaagaattatcttaaaaatagaagcgaggtgtgacgttgtcactttttgtaggtaaaaataggccacaatgggagaaaaggcaggtaaaatcctgccttttgtggggattaacggaataacggttttacagcgacgggaataatgagttgagcttgccattgcgccagagtcagacgcgccagttgccccaacgcctgataaaacggatgcccggcatgatcgataaatacgtccagaaagcggggcgaccacggaaacagatgccaggccaggagttgttcgcattcatgatgacggccattctcggcaagccaggccgccagcaacaacagcgccccaaaatgatcttctggctcgttttgctgcatttcaaactgaatcccgttttcgcgcatccactgacgtagcgccaacgtagaatcgccaaataatacgctctcacgatccagccagacggaaccccacggcggagacggcagagcgtaagggccgataaacaggcgctgccaggcttgtggcaacgactcttcgctgtgggtcttaaacatagccgccacaggtgcaagcgcctcggcatcaagcggccactgcgcctgccagtcgtcgtttaatagcgcctggaccagaggagcggtttcgtggctttccggcgaataataaaacaacgcgccaagaacacgcgccgttactgcaaaatcatcacgttgtaaaaaagtggtcattcaaacaatcccgaaaggtgcgggtcgccccgcacgcataaattaacctgcgacggccatacctacggtcatatgcaggccataaaaaagtccgcggccaataatttcgcccgccagcaccagtacgacaccgagcagcaaaccaacggtatgcggttcgcggcgacggattagtggacatagccagcaacctaatccggcagcaagcaagacaatgcgccagacctgtagcataccgtaatccggtgcgagatggctggcctgttgcacggaactgtgaatggctgagagggacagtccctgtagtacgatgaccgccacgcacaccaccaacgccaggccgctaatactggcaaacgtcacgctgcaaaatgggacgcgcgcgatgcgtagcagtagcgccgcaaacaccggaccgcacaggaatgccgtgaggaaaaaggccagcgtggtgtagccattataccaggttggcacggtatctatctgataaacgagcgtcattgcccagatgaatgcaacgccgagcgccatactgaccagcagccacactttacccagcgccgggggcattttaccgagtaccgccaccagccaccagatgccgcctacggcaaagaacaccgatcctgcggcgatttcattactcagtgcggaagcgcctacgcggttaagcgagttaaacgcgcgcatcggcaagccgagatgcataatcgacgcgaggaatcccagtcccatcaccagccacagaaaaaacatgctgcgcacgatgcgttgttttgccacatcgtctttggtggttaaccagccatatccactcacgatcagcgccccggccacacattgacccagcaccgtaaacaggaccagcggccattcatgccatccacttcccatcttatacctccttcggattggccagataaccggtggtgtccccggtcgggcggctgttggcgttgggtttaatcacaatattcggcttcgtgaaatgcgtgcgcggcaacggcgcgacggcagccagctcaccgtgttttttgcgcagttcgtctatcgggccgaaatccagcgcccgcagcgggcaggattccacgcaaatcggtttcttgccttccgccacccggtcataacagccgtcgcacttggtcatatgacctttggccgcgttgtactgcggcgcgccgtacgggcaggccatgtggcagtagcggcagccgatacagacctcttcattcaccaccacaaaaccgtcatcgcgcttgtgcatcgcgccgctcgggcagactttggtacaggccgggtcttcgcagtggttacaggagatggagagatagtaggcaaagacgttctggtgccagacgccgttatcttcctgccagtcaccgcccgcatactcataaatgcggcggaagctgacgtcgggagtgagatctttgtagtccttgcaggccagttcgcaggttttgcaaccggtgcaacggctggaatcaataaaaaatccatactgggttgtcatcggttactccttacgccttttcaacctgaacaagattactgtgtgacggattacctttcgccagtggggaaggccggtgcgacgtcagaatgttaatggagccgccgcgatcgactttgtcgccaaacatgtcggcatttaaccaggcgccctggccgatagcggtgacgccaggcaatatgcgcggcgtgacttttgccggaatgagcatctctccattctggttaaagacccgcacggtgtcgccgtgctgaatgccgcgcgcttgcgcatcaatcgggttgatccagatctcctgcggacacgcctgttgcaggacgtcgatattgccgtagctggagtgggtacgcgctttatagtggaagccggttagctgtagcgggtagcgctgacgaagcggatcgtcccaaccgtcaaagcctggcgtataggcgggtaaaggatggataatctcatctttcttcagctcccacgtgttggcgagggttgccagacgctcggaatagatttcgattttaccggacggcgttttcagtgggttggcggcagggtcttcgcggaatgagcggaaagcgacgtagtgctcctccgggcattttttcttgaaaatccctgtctgtttcatctcttcgtaatccggcatttccgggttacgcgctttggtttttgcgtgcaggtatttgacccactcatgctgcgtgcggccttctgtgaaggtctggtatacgtccggaccaagccgtttagccacttcactgagcgtccagtaaatgggctttctttcaaatttcggcgaggtggcgggctgaccaagaatgacatagcccatattgcctgcggattcgtgggaaatcagatcttcctgctcggtcggcattaaatcaggcagcagaatgtcgcaatattttgccgacgcggtcataaagtgctcgatgccgacgatcatttcacatttactgtcgtcctgaagcacctcgtgggtgtgggcgatatcgccatgctgattgatcagcgtattactggcgtagcaccacaaaaatttgatcggcacgtcgagcttgtcttttccccgcacgccgtcgcgtgtggcggtcatttccgcgccatgatcgatagcgtcggtccaggtaaagaccgaaatctgggtttttaccgggttctccagcataggaaaccattcgacgcccagatcccaggtgccttcgcgcacgccggaattaccgccatttatgccgacgttaccggtgagtacagacaacatggcgattgcgcgtgcggtctgctccccgttagagtggcgttgcggtccccagccctggcaaatgtaagccggtttcgccgagccgatttcccgcgccagttgaatgattttttccgccggaatactggtaatctgcgcggcccattgcggcgttttagcaataccgtcttcgccctgacccaaaatataggctttatagtgcgcgttacgcggggccgaggcgggcagagtggtttcgtcgtagccgatgcagtatttatccagaaacggtttatcaataagatcttcggtaatcagcacccagccgattgccgccgccagcgcgccatcggtacctgggcgaatcggcagccactcgtcttcgcggccggcagcagtgtcgttataacgcgggtcaatgacgatcatccgggcgttggagcgttcgcgcgcctgttcgacatagtatgtcacgccgccgccgctcatacgtgtttccgcggggttattgccaaacatcaccaccagttttgtattggcgatatcatccggactgttgccgtcgttgccgccgaacatatagctcatggccgcgctgatttgggcggtgctgtagctaccgtaacggctgagatagccgccgcaggcgttcatcaggcgatacggtacgttagaattggtaatattgccgccgtccacgccggtaccgtaaaggacatgtaccgcttcgttgccgtagtccttgaggatgcgtttaaggttatcgccgatggtatccaacgcttcatcccaactgatacgttcgaatttgccttctcctcgtttaccaacgcgtttcatcggatatttcaggcgatcgggatgattcatccggcgacgaatagaacgaccgcgcaggcaggcgcgtacctgatggttgccatattcatcgttgcccgtggtatctgattcaacccaatatacggtgtcatcttttacgtgcaggcgcagcaggcagcggctgccgcagttaacggtacatgaactccagaccgctttttctgccatattgccagatgcgaggtctgctgcggcgtgggcgatgcgggagaacggaagggtgaaagcgctactggcaagcgcaaggctaccgatagcggaggttttcaccaggcttcgtcggctgatactggccgccattaatgcctcagggttggtgattttcataacagctcctcactatgctcatccaaaaaagagttttaaatgtcgttgtgttcgcaaaacggggagctccgggcgcgtaaaaacgccccggagcaggcggcttagattttttcgatttccaccagatttgtatgttgaggattcccttttgccaggggggaaggacgcagcgtcgtgagcgtattgatgcaggcgccgtggtcaattttatcgccagccatatccgcattatgccatgcgccctgacccatcgcgctgacgcccggcagaatacgcggcgtgaccttggcgggtagacgcacttctccacgatcgttaaagacgcgaaccttatcgccattcgcgataccacgtttttgcgcatcaagcggatttatccacacctcctggcgacaggcggcctgcagaacatcaatattgccgtagcttgaatgggtacgggatttatagtgaaagccaaacagctgtagcgggaaggtgctccgcttcggatcgtcccatccttcaaaagtaggggtataaatcggcagtgggcttatcacgtcgccttccgccagctcccaggtactggcgatgtgagcgagtttgcttgagtagatttcgattttaccggacggcgtttttaacggattggcctgcggatcttcacgaaattttttataggcgacaaagtggccgttgggatctttgcgtttatagatgcccattttttttagctcgtcatacgcgggcaatgccggatctcttgcctgcattttggcgtacagatattgcagccattgcgcctgggtacggccttcggtaaaccgctgatacacatcgtcaccgaggcgtctggcgatttcgctgagtacccagtagatgggcttgcgttcaaacttaggcgtcgtcgccggttggataaaaatcagatatcccatattgccggcgtaatcattggggatgatatcttcctgttcgacggtcatgagatccggcagtaaaatatcggcgtacttcgcggaagaggtcataaaattgtcgatgaccacaatcatttcgcattttgcttcatcctgaagaatttcatgggttttattaatatccgaatgctgattaatcagggtgttgccagcgtagttccatagaaatttgatcgggacatccagcttatctttgccgcgtacgccgtcgcgcagggcggtcatttccgggccgcgcgcaatggcgtccgtccagctaaagcaggagatggcggttttaacgggattctccaggaccggcagacgttcaatggtaatggtgtaagtggattcgcgtgcgccgccattaccgccatgaatgccgacgttgccggtcagaatcggaaacatggcgatggcgcgagcggtttgttcgccgttcgcctgacgctgcgggccccaaccctgacagatgtaggccggcttgacgctacctatctcgcgcgccagtttgataatccgatcggcggggatgccggtaatgtgtgacgcccactgcggcgttttggcgataccgtcctcgccctggcccaaaatataagccttataatggccattggggggggcgtcagccggaagggtcttttcatcgtagccgatgcaatagttgtcgagaaaaggctggtcaacgagattttcgttaatcaatacccaggcaattcccgccaccagcgcggcgtcggtgccggggcgaataggtatccactcgtcttcacgtccggcagcggtatcggtatagcgcggatctatcacgatcatgcgcgcatttgagcgttcacgcgcttgctccagaaaccaggtaatgccgccgccgctcatgcgtgtttcagccggattattgccgaacatgaccaccagtttactgttttcgatatcagatgtgctgttgccgtcgttggatccataggtgtagggcatggcgcaagaaatttgcgcggtactgtatgagccgtattgattcaacgaaccgccgtagcagttcatcaaacgcttcaccggcgaggcggaaggcgacgagcgggttatgttgccgcctacgatgccggatgaatagtggatataaacggcttcattgccgtagatctctacggtctttttcaggctggcgctaatggtgtccagcgcttcctgccagctaatgcgttcaaatttgccttcgccgcggcggccaacgcgtttcatgggatagttaaggcgatccggatggttaatgcgccgacggattgaacggccccgcagacaggcgcgaacctgatgattgccgtagacatcgtcgccagtgttatcagtttcaacccaccagacttcattatcttttacatgcagacgcagggcgcagcgactgccgcagttgaccgaacaggcgccccagacgattttatcttcttcgttgcgcatagcctgctgcaccgccgcggccgcggtacgcatcccaaacggtaaagatacgcctccggcagccagcgccagtgagccaagcgccgctgatttcactaacgtcctgcggctaacgcctgtttgctgcttttctccgggcatcactcactccattgtcgttatcgtttcgctatatattaatgactatagcgaaattattaacatgctaatgatgtaatgagtttacccctttgggagtaaggattattaatccatgtcaaagagcgttaccctccggacccggagggcaggaggaggttattgtggttcggcggatgaaccgtcctgagcgggagaggtattggctggcgcattgccgctgctggtgcgggtataaagaattttatgcgtgtcgttcgcgcaatggcccaccacctgtgagtccggctgatcggcctggtcgtataggaacgatagtgagcgtaaaattatccgccggcacgccgttattgatgatacgttgttcgatatcgctttttactctctcgcacgatcccggtgccgccatcaccagcgagggggcgctgactaacgccagagcggctattgcagttgcgattttcatcatgaactcctgtgattaatgacgatgttctaagcttagcatttttcgtgtaaataactgtatttgctaatatgatgataaatatcttttcatcctggtgacacgcgtgaagaaaccccttttactgacgttattgtgcatgatactggcaggttgtgataacccgaaatcccccgagtcttttacgccggaaatggccagtttttcgaacgaatttgattttgatccattacgtggtccggtaaaggatttcagccagacgttgatgagtgagaatggcgaagtggcgaagcaggtcaccggtacgctttcacaggaaggctgttttgatacgcttgagttacacgatctggagaataatacggggctggcgctcgtgctggatgctaattattaccgggatgctcagacgctggaaaaaaaggtgcagttacaggggaagtgccagctggcggcgttgccttcggcgggcgtgacttgggaaacggacgacaacggttttgtggtatcggcgacgggcaaagagatgaaggtcgagtaccgctatgatagcgaaggttatccgttaggtaagacaaccataaactcgcagaatacgctctctgtgacggcaaaactctccacggactcccgtaaaaagctggattatacggcagtcagccgggtggatgatcgacaggtcggcaacgtcacacagagctgcgaatatgatgcgtacgcgaaccctgttgactgccggcttgttatcgtcgatgagagcgttaagccggcagtgtcccaccattacaccattaaaaatcgtatcgattactactaaaccgggcgcggtgcgactctccgtgactaccgcgccgcgcttactgcgcggtgggtttcaggagcgtagaactggacgttttatgttcatccagatactgctgctggaagatacacatgcggatggtgttacggtattcgccgttaatgaagaactcatgaatcagctcgccttctactctaaacccgagtttacggtagatgtgaatcgctttttcattctctttatcgacgatcaaatacaatttatagagattgagtacggtaaatccgtaatccatcgccagtttggccgcgcgtgacgccaggccttttccctggtactccggcgaaataataatctgaaattccgcccgccgatgcacatggttaatttccaccagttctaccagtccggcgttttcaccgtcgcattcgacgacaaagcgccgttcgctttggtcgtggatgtgtttgtcgtagagatccgacagttcgacaaaagcctcatacggctcttcaaaccagtaacgcataacgctggcattattatcaagctggtggacaaatcgtaaatcttcacgctcaagcgggcgcagtctgaccttgtagtcacttgtcatactgtatccttacacttccttttagttatcctgcatcagggcgtaataacgcgacctgtacgacgatccagacaccgcagagtattgggttcccaataggcgttgatgttggcgctttgctcgcatttatcgcggttatcaaaggcggcatcggctttgtcccactctttttctgcgcgggtattcactttctgacgcagactgcgagtgtcgttccattgttccttttccatcgccgcttcctgacgactttgtgcgctatctcccgattcaatcaccagtttactggtttcagcgaatgcggaagtagtatatacaacggccgccaacgtaagcattgccgtcaggcaaaggcgtttgctcagcgtattgttcatcacaacatcctttcattagaggggaaaaagcggtaaaccacctgtaaattctacaccaatccttatgcctggcatatacacaagaatggccggataaccgtaacgatattctgttgtattatcacttatcatttcgtaaccaaatgaatctcatgctaaagacgactctgcttttctttgtcaccgccctctgtgaaatcattggatgttttcttccctggctatggattaagcgcggcgccagcgtgtggtggcttctgcccgctgccgcgtcactcgcgttattcgtctggcttttgaccttgcatccggcggcgagtgggcgggtttatgcggcttacggtggggtatatgtctgtactgcgctcctgtggttacgtgttgtcgatggcgtccggctcacggtttatgactggagcggcgcgctgatcgcgctgtgtggaatgctgattatcgtcgttggatgggggcgtacgtaacattgccgcgctgccagaacattttgtgatctggcagcgctttttagataaatatacttgtatggtagtagctcagttgggtaaatttcctgcatcccataatgcgatgtaaggaataaaaatgaagattgtaggggctgaagtttttgttacgtgtccagggcgtaacttcgtcaccttaaaaataaccacggaagacgggatcaccggtctgggggatgccaccctgaacggacgcgagctctcggtggcctcgtaccttaccgatcatctgtgtccacaactcatcgggcgggatgctcaccgcatcgaagatatctggcagttcttctacaaaggtgcgtactggcgccgtggtcctgtcaccatgtccgccatttccgcagttgatatggcgctatgggatattaaagccaaagccgccaatatgccgttgtatcagttactcggcggcgcttctcgtgaaggcgtcatggtgtattgccatactacaggccacaccatcgacgatgtgctggaagactacgcgcgtcataaagagcaagggttcaaagcaatccgcgtgcagtgcggcgttccggggatgaaaaccacctacggcatggcgaaaggtaagggactggcctatgagcccgcgacaaaaggccagtggccggaagaacaattgtggtcaacggaaaagtatctcgattttacgccaaagctgtttgacgccgtgcgtaatacgttcgggtttaatgaacatcttctgcacgatatgcatcaccgactgacgcctattgaggctgcccgctttggcaaatgtattgaagactatcgtttgttctggatggaagacccgacgccggctgaaaatcaggagtgcttccgcctgatccgccagcatacggttacgccgattgccgtaggcgaagtctttaacagtatctgggattgcaaacagctcattgaagagcaattgattgactatatccgcaccacgattacccatgccggtggtattaccgggatgcgccgcattgccgattttgcctcgctctaccaggtgcgtaccggttcgcatgggccgtccgatctgtcgccggtttgtatggccgcggcattacattttgacctgtgggtgcctaactttggcgtgcaggagtttatgggctactccgaacagatgctggaggttttcccgcataactggacgttcgagggcggctatatgcatccgggcgacaagccaggactgggcattgagtttaatgaaaaactggcggcgaaatatccgtacgatccagcctatttgccggtggcccgtcttgaagacggcacactgtggaactggtaaggagcgaaaaatgaaaagcatcgtaatcgaaaaaccgaatacattaaccatcgaaacgcgcgcgcttctgcagccagcatctggcgaagttcgtattaaagtgaaactggcgggtatctgcggttccgacagccatatttatcggggacataatccctttgcaaaatatccccgtgtcataggccatgaatttttcggtgtcatcgacgcggtaggcgacaacgtcaatcgcgaccggataggagaacgggtatccgtcgatccggtgatcagttgcgggcattgttacccttgttcagtcggtaaacccaatgtgtgtacctcgctggtggtgctgggcgtgcatcgtgacggcggtttcagcgagtatgcggtggcgccggcccgtaatgctcatcgcataccggacaacatcgcagaccatcatgccgtcatggttgagccgtttaccattgcggcaaatgtgacggggcaggtgaatccgaccgagcaggacgtggcgcttatctatggcgcaggcccgatgggactgacgaccgtacaggcgttgaagggggtttatcaggttaaaacggtcatagtcgttgatcgcattgaagaatcgcctgcggcacgcattgtcctgatgggattttccagcgacccgtgtgagattgtacagcagggtattaccggaaaagagctggctatttattcatcgcgtcttaatgccaataaattcccggtcgtgattgactggctgaataaagggcttattgatccggataagctgataacgcatacatttgattatcaacatgtcaccgacgcgattgagcttttcgagaaagaccagcgtcaatgctgcaaagtcttactcacgtttgcgaaataatataaatacttgcgagtaagtggtacgcatcttacctcttagagattgcctatatgacacaaataaagcatgaacgatcgactcaggatttagtgcgcgctgccgtatctggctggttaggcaccgcgcttgaatttatggattttcagttatattcactaggcgcggctctggtcttccatgagatatttttcccggaacagtctgccgcgatggcgcttattctggcaatgggcacctatggtgcaggttatatagccagaattatcggcgcctttgtttttggtaaaatgggcgaccgcatcggacgaaaaaaagtattgtttattactatcaccatgatggggatctgcaccacgctgattggcgtactgccgacgtatgcgcaaatcggcatttttgcgccagtattactggtaacattgcgaattatacaggggctgggcgccggggcggaaatttccggcgcgggtaccatgctggccgagtatgcgccgaaaggaaagcgtggcatcatttcctcgctggtcgcgatgggcaccaattgcggtacgttgagcgcgacggcgatctgggcggtgatgttctttgcgcttgaacgcgaacaactgatcgcctggggatggcgtattcctttcctggcgagcgtcgttgttatgatattcgcgatctggctgcgaatgaatctgaaagaaagtccggtattcgaaaaagtaagcgaaggcgaaaaatcgccagcgttaacgcctgcgtcagaaaatacattgggcgcgatgtttaccagcaaatctttctggctggccaccggtttacgttttgggcaggcggggaattccgggcttattcaaactttccttgccggatatttagttcagacgttattatttaacaaatctatcccaaccgatgcgttaatgataagttccgtaattggttttatcactatcccactcttggggtggttgtccgataaatacggtcgtcggctaccgtatataatattgaatatctccgcgattattctcgcctggccgatgttgtctattgtggtagataaaacgtatagccctggcgtaattatggcggcgctcattgttattcataactttgccgtgctgggattatttgcgctggaaaacatcaccatggcggaaattttcggatcgcgtaatcgcttcacccggatggcgatttcaaaagaggcaggaggcctggtggcggttggctttggccccgtcctcgcagggatcttttgtaacatgaccgattcctggctgcccatcttaattatgctggtgctctactcgtgtattggtctgatttctgcgctgttgatgccggaggtcagagatcgcgacctgagtttgcctgaggatgcggcggaagcgacagcggcagagaagttacgccactccgcaacccagacgagttaaatcgtgtcgacggtatggccggaacgttaatgcggtttcggccatgctgtccggtcacttttgtttaattagcgtaaatccaaatgcaccagggcaggcgttactctgcgactgttccgctttcagaatatagaggttataaaatgcaaaacaggcttttatcggcaaaggcgacgcttcctgattacgatcgcgcggcgctggcggcgcggatggtccatctcggttttggcgcgtttcatcgcgcgcatcagggggtttatacagatattctggctgcggagcagcatagcgactggggctattatgaggttaatcttattggcggcgaacagcagattgccgatctaaagcagcaggataacctctataccgtggcggagatgtcggcggatgcctggacggcgcgtgtggtgggcgtcgtcaaagcggcgttgcatgttcaggttgatggtctggaacgtgtgctggcggcgatgtgcgaaccgcaaatagcgattgtgtctctgaccattaccgagaaagggtattgtcattcgccagccacgggtcaacttctgctggaacatcccatgattgccgccgacctgcaaaatccgcatcaaccgctaacggcaccgggtattattgtcgaagcgttagcgcgtcgtaaagccgcaggcttaccggcatttaccgtgatgtcctgagacaacatgccggaaaatgggcatgtgacgcgtcaggttgtgacggcttacgcccgggaggtggatgcggaactggcgatatggatcgagcaaaacgtgacatttccgtcaaccatggttgatcggattgtccctgcggtcacgccggagacgctggataaaatcgaacaactgaccggcgtgcgcgatccggcgggcgttgcctgtgaaccgtttcgtcagtgggtgatagaagatacgtttgtggcggggcgtccgcagtgggaaaacgcgggcgcgacgttggtcgccgacgtggttccgtttgaagagatgaaactgcgaatgcttaacggcagtcattcattcctggcttatctggggtatcttgccggctatcagcatattaatgactgtatggatgacgacaactatcgtctgaccgcgcaggcgttaatgttacgcgagcaggcgccaacgctgaaagtccagggggtagatttacagcgttatgccgatcagttgattgcgcgttaccgtaatccggcgctgcgtcatcatacctggcagattgcgatggatggcagccagaaacttccgcagcgtatgctggactccgttcgctggcatcttgctaatcatagcgattttgatttgctggcgctgggcgtggcggggtggatgcgttacgttggcggcgtggatgagcagggtaaggcgatcgacgtcagcgatccgctattgccggttattcagcgcgccgtggcaaacagtgaagaaggcgccagtcgtgttaaggcgctgctgggaatggctgaaattttcggcaacgatttgccgcaggcggcgcggtttacgcaaaaagtgcaagaagcctatgacagtttactgacatatggcgcgaaagcgagcgtggcgaaatatgccgagcgcttgaaatagcgtaacagagacccggtagcattatgctaccgggaaggccggagcggttcttagcggccagtggtatcagttcatgccaagacgaatcagttcgactggcgcgaatttaccttcacaaccttcgacaatcaccgttttgccgcggcgaatttgacctgcatccagaccttcgctctcaatggctttgataatcccggtatggcccgtgccgcttatcatgacccggctaccggtggtgattgcgttacggttacgatcgtatgtcatcatggtgttttctcctttcaaacttactgccaaagcccgcaggtttccccgcatgacgggcgacatataaatacgcttatcgttgcggattttttttgtttttgatcaagctcacggctttttaggcgggaatgtgcagggcgagaaagcggagaaggcgtctcaccccgacgttaaagggggttactcttcgctaaaccagccgctgttttcctgacggataagctgaacggattcgctaatttcctgcaaatgctgggtcattgcgctctcaaccgcattgccgtcacgattttccagcgcggagaaaatatcatggtgctggcgcagcaacatctccggcggagaaacatgatccagactcatatagcgaacccggtcaattgtcgctttgatattttcaatggtatcccacgctaactggcaatcggcgatctgcgccagtttttggtggaaatcgtcatcaagctggaaaaaatcatcaatctgtttgcgctcgatggcaatatgttgcaggtgcaggttttgcgccagttgatagcactggttgtcggtgatcatcgccgccgcacggcggaccaccgcgcattcgatcgcctgccgaacaaagcagccattctgtacctgagaaagcgaaatcttattcacataactaccgcgctgagggcggatctgaatcaacccattttccgccagctttataaaagcctcgcgcaccggctgacgcgaaacgttaaaacgggttgagacctctttttctgatagcggcgtgccaggcgggataagacaatgcacgatatcacgccgaagaatacggtaaatttgctggttgacaggctgtgtagggttaagctgcgtttcgacggtcattcattcttactttttaggcggttgacccggatactctaccacttttccgtggcggtctataccgatcatgtttctggttgcagatacgtttgccagggattacccggcccgcagaccgggtataaccccttagctacggtggacgctgagccctgcgaaggattgggtaacaggcatcatttcaacggtattaatattcacatgcgcggggagtgtggccacccaccataccgcttcggtaatgtcttctggcgtgagcgcggtggtattttcgtaggttttacccgctttctcatcgtcgcctttgaaacggacgctggaaaactcggtgccgccaaccagacccggttcaatgtcggtcacgcgaaccgccgtgccgtgtaaatccgtgcgcaaattcaggctaaactggcgcacaaaggctttcgtcgcgccatagacgttgccaccagcataaggccaactgccggcggttgaaccgatgttaatgatatgaccgcgattacgttcgaccattcctggcagcacggcgcgggtcatataaattaagcctttattattagtatcgatcatagtttcccagtcttctacgctggctttatgcgccggttcaagacccagcgccagaccggcgttattgaccagcacatcaatatcgcgccactgcgcaggcagagaggccatcatctcttcgatggccgcgcggttgcgcacgtccagttgggcggtcaatacgttctcgccaagctcatcttttaacgcttgcaggcgttcatgacgacgtcccgtggcaatgactttatgtccattctcaacaaaacggcgtgcaatgcactcgccaaaccctgcggttgctccagttactaaaacgatcatcacacagttcctcaacgctttttgtgttgtattaccatagcacgcggcgtttatgaaagggtaatcctggttaacacggttgcggtcagcatagggggaagcttactcttatgatcaacctattttcaggagtgaaaaatgtcgacgaatcctttgttagaccagagtatgttgccttatcaggcaccgcgttttgatcggatcaaagattgccattatcgtcctgcttttgatgagggcgtgcggcaaaaacgcgtggaaatcgaggccatcgtcaatcatccggcggcccctgattttacgaatacgcttctggcgctggagcaaagcggggcgcttctgtcacgcgtcaccagcgtttttttcgcgatgacggctgcgcacactaacgatgaactccagcggttggatgaggccttttctgccgagctggcggcgctctccaacgatatttatctgaatagcgcgttattcgctcgcgtggatgccgtctggcaacagcgtcactcactggggctggatgatgagtcgctacggttggtcgatgttatccatcagcgttttgtgttggcaggcgcgcagcttgccgaagaggataaagcgcgactgaaagtattgaatactgaatccgcgaccttaatgagtcagtttaatcagcgtctgctggcggcaagtaaagcgggcgggctggcggtagatgacgcgcattgtctggaaggattaagcccggaagaaatgaccgtcgctgctgaagcggcgcgtgaaaaaggcctggaggagcgctggttcattccgctccttaatacgacgcaacagcctgcgcttgctacgctgcgcgatcgccagactcgcgaaaatttattcgcagcgtcatggactcgggcggaaaaaggagatgcccacgatacccgcgctatcgttcagcgtctggtagagattcgccgctgtcaggcaaaactgctgggtttccccaattatgccgcatggaaaatggccgatcagatggcgaaaacgccgcaagccgcactgagctttatgcgtggcattgtgccgccagcgcgtcagcgggtactcaatgaacaggcggaaattcagaacgtcattgatggtgagcagggcggctacaccgttcaggcctgggactggatgttctatgccgaacaggtacggcgggaaaaatatgcgttagatgaagcgcaactgaagccctattttgccttaaatacggtgttgcaagagggggttttctggaccgccaaccagctattcggcatcaccttcgtcgagcgttttgacattccggtgtaccaccctgatgttcgggtgtgggagattttcgactccgatggtgtcggcatggcgttattttatggcgacttcttcgcgcgggactcgaaaagcggcggcgcgtggatggggaattttgtcgagcaatccacactcaatgaaacccggcccgttatatacaatgtatgtaactatcagaaaccggttgatgggcagcctgcattgctgctttgggacgacgttattacgctcttccatgagtttggtcatacgttacatggtttgtttgccgttcagcgctatgccacgctttcaggtaccaatacgccccgcgactttgtcgagtttccctcccagattaatgagcattgggcgagccatccacgtgtgttcgaacgctacgcgcgtcatgtcgacagcggtgaaaaaatgcctgctgatttacaggaaagaatgcgcaaggcgagtttatttaataaaggttacgatatgactgaattgttcggcgccgcattgctggatatgcgctggcatatgctggaggagagcgtagcagagcagtctgtcgctgagttcgagcagcaggcgctggccgccgagcatcttgatttaccggcagtgccgccccgctatcgcagcagttattttgcccatatcttcggcggcggctacgcagcgggatactacgcctacctgtggacgcaaatgttagcggatgacggttatcaatggtttgtagagcagggcggcctgacgcgtgaaaacgggcagcgttttcgtgatgctatcctttcccgggggaatagtactgatttagaaacgctttattcagcctggcgtggacatgaaccgcatattgacaccatattgcaatatcgtgggctcgatcactaagctgatacggttgttcggcactgtcgaacaaccgcctgaaaatgaatcctgcacttctgatgacagccagttaaatttatggggttaagttgtctgaatataacgagggcgtgcattcggatttttctacttattttcccgtggtggcttgattgccaaagatttattaccgcttcgctgttgatgttttcaaaaaatatattttccgccatgtggtggtattatgtaaataatgcagaaatgaatttaacactgcgcacagggcgactagatttagaactgtatcacatgatatgagaagacatatcatatttaaaacgcaacatcatcatgaggattatattatggcagaacatcgcggcggttccggtaattttgcagaagataaagagaaagcctcagaagcaggtcgtaaaggcggccagcatagcggtgggaactttaaaaacgacccacaacgtgcatctgaagcgggtaaaaaaggtggccagaatagccacagtggcggacggaaatccggcaattaattttactgctgatatttcataaatatattctgaaatattgcacatacgatgcgggccataggctcgcatttttttattctgaccgggagttattctgaccggtcagatgaaattattgtttatgctttcttcgttaacagaaaaagcaattcagcgagggcgaagcgtacgcatttttccaatacttcctgacaatctccgttgaaatgttgtcggcttgtaaaagttgtattgttaatattccaggcaaaccaaactgtgcccgccggcgtgccatcttcgccgccttccggaccgccatagccgctgatcgctatgctgatattgacctcagcctgatccttagcgccctgtgccatttcagtaacaaccgcttcgctgacggcggtatgttcggcaagactgtggcgttgtacgcgtaagatttttgctttggcttcatcagtaaaggtgacataccccacaccgtaaaatgagggcgtatcttctgctgcgcacaatgctgacgccagtttcccgccagggcaggattctgcactggtcagacggagtttctggttaaccagtaaatcaccaagtttttttgtcaggctatcgacggattcggcttcatcaagggtgacaatatcgtgctgttctaatctcatcgtttatttttccgttacagagacaaatgaaatctgttcgttcttctcaagtatggcatatttattttatgacattgtcagtgaatgattattttatccagttaccaacaaacccgctgttgcataacttgcttactttcttacggcgatgactgtcattgattatgtggaaggccattatcctcaaaaaataaagccgattattctgaattgctatccagacgttgatgcatatgacttcagctatgtggcaagttaactattacgccgttacgctttcgcgctcactggcgctgatatcggttgcatattaatccggatgggttgattttattgcttaatattctgcgggtaaattcatgtttgtaaaaactaaaaatagcggccagacttaatacgtcaaatagacgttattaaggagagagcatgaaactacaggtggctgcatttttaagttttctgataatgccttacgcgctagcggaagatcaggggggattaaaaaaagacgtggcaccgccgccgcctcatgctattgaggatggttatcgcggtacggatgatgcagaaaaaatgaccatcgaacaggcaaaaaccctgcatgatggcgcgaccgtttcgctgcgcggcaaccttattgatcataaaggcgacgatcgctatgtatttcgtgataagtccggcgagattaacgtgataattccttccgccgtatttgatgggcgggaagttcagccggatcaaatctggacaagaaagcgaaggaaccgcttgtccgcgtgaaccgattgcaaaaataacgcgcgctaaccggcaatatccaggtcagccatacggggcatgcggctggcctgatactatgggtcttgtaaaagcgccctggggacaaaaggtcccataatgtcttattcaggtctggttgcgtatcgtttaagcttcattgatattgacggtgctacagtcgttagcgatccgttatcctcgcaagaatttgcccggtagcgtataagcaaaacacaaatctatccatgcaagcatttaccgctggtgaaccggcggtttttttttgcctgccatccagacaaaagcggccccttgcgcaacgatgcagcaaggggccggctctgcgagggattatctccgttcattaatcatcccatttgtgactgaaccaggcggccagaaatccggaaaataaaataattcctaatacaacgataaaaaggttaatactacctaacatctcgtttctccttattttagcgtgcatcctcttttttaaaaaacctcgtacaaactatagtactaatttatacttaagcaaagtctgaattgcgtatttattttactggaagggtaaagcattagaatattttcgtcagcgcccaggaatattcctgaattaccgcagttacagcagataattagcctgcaatatatagggttaacccagtgcgccagaaacagcgcacatgactggctgcagataattaacaggtgatagcctgttgcgtaggggtaatccgcattccttttaacatcagtgcccaggcgaacacaatggcgattatcaggacaacgaaaagcgaccaggcgggaagcgtcgtcaggatgacgccgctggccagcgggtttaccgccgcacccagccagcccagcgattgcgctgaaaaatagctggctttcatcccggcaggcgcaatgttgtcaattaacatatattcgccgggggcataaataatttcgccaattgtgaatactgccgctgaaagcccccaaaaaaacagattgtcgcctgaaaaaataaatccgatgagcccggcgataaaaaagacggtgccggtcgtcatcattggtcgaatattgacggcggtaagtcgacggcccacggcgtattgcaaactgaccacaataaccgcattaaccggcaggacgacggctaccactttttccgcgaagccgctatcggcaacgaccataacgtactgtgaaatacaggacgcaaaggcaacccccacaaaggaggccagaaatgccgaaagcgtaaaccacaataatgctttgtcgcgcagcagaacggagggagaccagatagcggcatttttcccctcgctggcggcaaccgaacgtgtcacccatacctgaataaagaccagcggaaatgcggaacagatagcggcaagccagaagggtaaattgatgctttgcatcaccagcagcgtgccgagcggcgggccaaccgtccagccgatattgagtacggtatagttgagcgaaaaaatccgtgtttttgttgtcgcggtgaggttatcggcgaaccaggccttcaggacggtagaaaaaaccgaataggcgcagttaataagcgcaaaaagcaggacaaccagtacgacattatgcaccattgggatggcgataaatccgcaggcgaaggcgataatcgcgagtaacatgtagcgctttttatcaaacttgtccgccagaatcccaaagccaagactaaagatgacgccgatcgttaacgcgctggtcagcgcgtagccaatcagatccacgcctaaaccgtactgacggttaagatagatggtcataaaggggagcgtggcgccgcgtccaattgtcaataacagcgatgaggcgagtagagccaacgtcgaacgtctcaatcctggattcatttttcctgcctgaaatggaggttacgtatcgggacgttttaatctaccgtgcccgcaaaagcatgatgtctgtacgctatagcgtagtcttaacataccataacgcaggattttgcccatcgtgtgttgttcaatgccatgctcacggtaaaaagaaaagtcctgttatggcgcactgatttccgataacttacctttttacaaaattttaataatgacaggggccgatgatgtcgcgtaaagacggttttttggcgttactggtggttgtcgtatgggggctcaattttgttgtcatcaaagtaggcctgcaccatatgccgccattattgctggcaggattaaggtttttactggtggcgtttccggcaattttctttgtcgcccggcctaaagtcccgcttacgctgttgctgggctatgggctgacgataagctttgggcagttcgcctttctcttttgcgcgataaagtttggtatgcccgcaggactggcgtcgttggtattacaggcgcaggccttttttaccatggcattgggggcgtttgtttttagtgagcggttacaacgtaagcagttagcggggatcgccctggcgattataggtgtactggtattgattgaagccagtctcaacggacagcatatagcgatgtcgggatttatgctgacactggcggcggcatttagctgggcctgcggcaatatctttaataaaaaaattatgcaacatagtccgcgcccggcggtgatgtcgctggtggtctggagcgcgctgatcccgatcctgccgttcctgctgtcatcgctgctactggagggggcggatcacattacgcaaagccttattaccatcgatatgacgacgatattgtcgctgctttatctggcttttgtcgccactatacttggctacggcatctggggcacgttactggggcgctatgagacctggcgcgtggcgccgttatcattgctggtgccggtagtcgggctggcgagcgccgcggtgttactcggggaaacgttgaccgggatgcagcttgcgggcgcagtactgattatggctggactctatatcaatgtgtttggatttcgtgtgcgccgtactgcgcgcgtcaggggatgaggcattatgttactaagaagacaaacgctaatttcagaccatgccgcggggtaatagcggcggacttgtcatagccagacggtactaaaaaaatgccccgcaaaacggggcaaagaggttaaaggtgttggtcgttataatagggcacgcctaattcatctgacttatcgctgttcacgctcacggggtgaaggtcatttggcggatcgcccacacagggcagaagcatcacatcgcggctattttgcgccacaggtaacaaagtttgttctgcaatgccatatccggaggcgataagtaacagacccggcagggcgggaaacagcattttcatggtgctcttcgcgtggcgcataaacaaactagtagttgccatggttcagcggcagcatataccgtgattcgccatgcatattggtgatccggtatttgtgtggcggcacatcaaaatagtttttgaacgtccgggtcaatgtttgctgtgactcaaagccatagcgttccgccagatagagaatgggctcgttgctctcttttaatttttgcgcgatttccgtcatcttacggctgcggatgtattgacctaatgaatgaccggtctcttttttaaacatccgttgcaggtgccatttggaatatcctgaacgctcagacactttttccagtgagagcggcgactccaggttatcctcgatccagtccaaaatgctatgaatagtaatagcgtcagtgttgcgtctggacatcgtcatacctcttttttgtctacggcagaattttcttgagcaaatactcaagcgttgccacttcgtccgccgttaagttttttgttaattcctgatgcaggtcttgccctggtcgttgatgacattgctcacaaattgccgcgccgtccggcgttagcttcaccagtacgccgcgtttgtcattaggattcggcagtctttcgatccagcctttgcacagcaggcggtcgagcatccgcgtcaatgcgccgagatcgacagacagcacttttttaagttcaaccggggtaatacatcccgcgcagcgtatcgagcacagcactttaaactgtgttgcggtgatatccagcggggataaatagttatttaacaggcgatcttttttttgatttaccatgtagatcaagcgacccagcggaatgatttcattgaacagatcactggtgcttttcaaaatggttgccccggcaagtaattaattttgtcagatactattgcccaggcaagtataagtcaactaaatgaattggccgatgccacgatttgctaaaaggcgtccggggtattgtgctgtgataacttgtaactaattgataattacaggttataggttgtaaaaaatattgacttgcacactggcgaaatggcgcgcctgggcaatttcactttatacttccggttcatgaaacgctgatgggtaagagatagtattatgatggatttgtttaaagcgattggattggggctggtcgtactgctcccgttagccaatccgctaaccaccgtggcgctgtttcttggccttgcgggcaatatgaatagtgcggaacgcaaccggcagtcctatatggcttcggtttatgtcttcgctattatgatggtggcgtactatgccgggcagttagttatgaacaccttcggtatttcgattccagggctacggatcgccggggggttaatcgtggcgtttatcggcttcagaatgcttttcccgcagcagaaggcgcatgagtcgccggaagcgaaaagcaaatcggaggagctggcagacgaaccgacggccaatattgcgtttgttccactggctatgccaagcaccgcaggaccggggaccatcgcaatgatcatcagttccgcttccacggtgcgtcatggcggcgagtttcccgactgggtcattatggtcgcgccgccgattatttttcttgccgtggcggtgatcctgtggggatgcttacgcagttctggcgctattatgcggctggtgggtaaaggggggattgaagcgatctcccgcttaatgggattcctgctggtgtgtatgggcgtgcaatttattatcaacggcgtgttggaaattattaaaacgtaccactaaggcgcattgtcgtctgccggaaacctgttcccggcagacgaatgtcttaatgcggttgttcttccagcgtcactggccatttgcggaatatgagcacagcccataccagcgcggcacaggcgggtatggcgccaatatagccgatggccgacattgaccagtgcaaactcacctgattgcctaccagcgcgccagcgccaataccaatattaaagatgcctgaaaatagcgccattgcgacatcggtcgcgtccggggccagcgccagtactttcacctgcataccaagccctatcaccataatcgcgatgccccagaaaatgctcagtatggccagatgcgcttcgctatccgccgcaggcagcagcagaagcagacagacaaccagcagggcaatagcgatactgacgagcgacgaggcatgacgattacccagtttaccaaacacaaggctgccgatgatcccggcgccgccgaggatcagtaacaggacggtagcaaaattcgcactgagcccggcgacattctgaacgaacggttcaatatagctataagctgtgtaatgcgcagtcaccacaacgacggttagtacatagaggctcattagcgccgggcgccggaatagcaaaggtaaactttttagtgagccggaatgctcgctcggcaatttcggtagaagcttaatcagacatagcagcgtaattaatgcgcccatgccgatggcaaaaaaggtggtgcgccagccaaaatactgaccaacaacgcgacctatcggcagcccaagcaccatggccaacgcggtgccggtcgctatcagacttaatgcctgcgcgcgtttcccggcaggggccaggcggatcgccagcgaggcggttatcgaccagaaaatagcgtgggcgaaagcgataccaatacggctaatgaccagcacggtaaagttccatgccagaaaggagagcacatggctggcaataaacaaaacaaacagacaaatgagtagcttacggcgctccatttgactggtaagaagcataaaaggcagcgacataacggcaactacccaggcgtaaatggttagcatgatgccgacctgcgcggtttgcatatgaaagctttcagcaatgtctgatagcaaaccaaccggcacaaattctgtggtattgaaaataaaagcggcaatagcaagcgtaactacccgtagccacgcgaccttgcgggaaactggattgattgtcataaaaatatttcgggttagttgcgagaaggtgagaccgcgatcttaaaacgtttactggcgaaaagacaatcattttgtgacctgcttctcatttacttcgcaggccgtttcgtcttcagtcggcgctcgccagttgggcgttaagtaactcgataaaggcctcaagttgacgcgtcatcgccccgcgtcgccacattagccaggtgctaagccagcgccacttctccgccaacggccaggcttccacctgatgatgtcctggcatactgttgagcatacttgctggcatcagcgcaatacctgcgccggcaattacgcacgccaacattccatgatatgactccatttcgtgaatcgtaccgggggtcgcgccatcggcatgaaaccagctttcgaaatgccgtcggtaagaacagttggcgcgaaaagcatagatgttataaccattcacctcgctggcccgcgaaacgacggaatggccgtgtggcgcgacgatcatcatctcttcctggtaagccggtataccttccagccccggatgcattagcgggccatcaataaaggcggcgttcagctttccttcgagcacgccatccagcatggcgccggaaggaccggtcgttaacgcgaactgaattttagggtaacgctggttataacccgccagcagcgcggggatacgtacggcggcagtactttctaacgcgccgagtgaaaacagtccttgcggttcctctccggcaaccaccatacgggcttcatcaaccagcgccaggatctgctggctgtaacgtaaaaagttatgcccggctggtgacagcctgagtcgctggttttcgcgaataaacagagagacgcccaggtcggcttcaagctggcggatacgcgtggtcagattggacggaacgcggtgcacttttgccgccgcctgcgtaatgctgcccgtcagagcgacagcgttaaacatttccagttgcgtcaggtccatggttttctcaattcgtgaatagtctggttaatattattcatttttcagaaagggtaaagggcgtcatgatggtacaactcccctgataacgagagaaagaacatgaccatgatgactgcaacacaggcgttatccgttaatcctgcgaccggccagacgctggcggcaatgccctgggctaacgcgcaagagattgaacatgcgctgagtctggcggcgagcggtttcaaaaagtggaaaatgacatcggtagcgcaacgggcgcaaacattacgcgatattggtcaggcgcttcgcgctcatgcagaagagatggcgcaatgtattacgcgtgaaatgggtaagcctataaagcaggcgcgtgcggaagtgacgaaatccgctgcgttatgtgactggtatgcggaacatggtccggcaatgctgaatcctgagcctacgctggtagaaaatcagcaggcggtgattgaataccgtccgctgggcgtcattctggcgataatgccgtggaattttcctttatggcaggtgttacgcggggcagtgccgatactgttggcggggaatagctacttgttaaaacatgcgcccaatgtcacgggttgcgcgcagatgatagcccgaatcttgacggaagccggtactcccgctggcgtctatggatgggtgaatgccaataatgagggcgtgagtcagatgattaacgatccgcgaatcgcggcggtgacggtgaccggtagcgtgcgcgccggcgcggcgattggcgctcaggctggggcggcgctgaaaaagtgcgtactggaactgggtggctcggatccgtttattgtactcaatgatgccgatctcgagctggcggtaaaagccgcggttgccggacgctatcaaaacaccggacaagtctgcgccgccgccaaacgttttattgtcgaagagggcattgcgcaggcgtttaacgatcgttttgtggcggctgccgcagcattaaagatgggggatcctctggttgaagagaatgatctggggccgatggcgcgctttgatttgcgtgatgaactccatcaacaggtgcaggcttccgtcgccgaaggcgcacggctactgttgggcggcgagaaaatcgccggggagggcaactattatgccgcgaccgttctggcggatgtcactcctgacatgacggcatttcgtcaggagctttttgggcctgttgccgccattaccgttgcaaaagatgcggagcacgccctcgcgctggcgaatgacagtgagtttggcctgtcggcgacgatctttaccgccgacgatacgctggccgcggagatggcggcgcgtcttgagtgcggtggggtattcattaatgggtacagcgccagcgatgcgcgtgtggcattcggcggggtgaagaaaagcggcttcggtcgcgagctttcgcactttggtttacacgaattttgtaatgtgcagaccgtctggaagaaccgcgtctaatcgccctgacgtcgcgtggcgccctctgctatactcgcaggccttttcagacctgcgagcaaggagcatgttgtggccagggccatggataatgcaattttagaaacgattttacagcgcgttcgccccctcattggccagggcaaagtagctgactatattccggcattagcgtccgtcgagggttcaaagctgggaatagcgatttgtaccgtggacgggcagcattatcaggcgggcgatgcgcacgaacgcttctctattcagtctatttcgaaagtgctcagtctggtgatggcgatgcgtcattatccggaagaggagatctggcagcgtgtcggaaaagatccttccggctcgccgttcaattcgttggttcagttagagatggaacaaggcatcccgcgtaatccatttattaatgcgggcgcgctggtggtatgcgacatgttgcaagggcggcttagcgcgccgcgtcagcggatgctggaagttgcgcgcgcgctttgcggcgtatcggatattacatatgacgctacggtcgcgcgctctgaatttgagcattccgcccgtaacgccgctattgcctggctgatgaaatcattcggtaattttcatcatgatgtgcctaccgtgttgcaaaattacttccactactgtgcgttgaaaatgagctgcatggaactggcgaggacgtttgtctttctggcgaatcagggcgaggcgtttcatctcgacgagccggtagttacccccatgcaggcccggcagattaatgcgctaatggcgaccagcggtatgtatcagaatgccggcgagtttgcctggcgggtgggattgcccgctaaatccggcgtgggcggcggtattgtcgccattgtgccgcatgaaatggcgattgccgtctggagtccggagctggatcctgcgggaaactctctggcaggtatcgccgcgcttgaacaattaacacaaacgttaggacgtttggtatactgatgaatgcgcttgaaccgctctttgcccgcctggcgcgatcgacatttcgttcgcgctttcgtctcgggataaaagaaagacaatattgctgggataaaggcgcggaggtgattgataaacacgccgccgattttatcgcccagcgactggtgccagctcacccggcgaatgatggtaagcaaacgccgatgcggggccatccggtatttatcgcgcaacatgcgacggcaacctgctgtcgcgggtgcctggcgaagtggcaccagattcctcagggagaaccgctgagtaaagcgcagcaacagtatattgtcagcgttattcattactggctggtcatacaaatgaatcagcggtagggtagcgcgtcgttgctgacgctttccccgataaatcaccctataccactgatagcagccgttgaccgtcatatatctcatgtgctgaaatgtctttttagttacaacatacatttggttgtttttttccaacgcctgtcagcaccatgcaaaaaaatgttctacagagcagggaatccgtgtatcaccagaagcttgcaaccttgatctggatcacgtttaatgacagtgctttttcacctgctgaagataatcatgatcgttagaccacaacagcactggattcgcctgatatttgtctggcatggttccgtgttatctaaaatcttttcacgactgctccttaactttcttctttctatcgccgttattatcatgctgccctggtacacaatgctgggtattaagtttacccttgcgccgtttagcatactgggcgtcgctatcgccatttttcttgggtttcgcaataatgcctgttatgcgcgttacgtcgaagcccgacatttgtgggggcagttgatgatcgcttcacgctcaatactgcgagaggtgaaaacaaccttgcctgatgaacgcggtatcgaggattttgttcggttacaaatcgcttttgcccactgtttgcgtatgacattgcgtcgacagcctcaaacgcaagttctgggaaactatcttgaccaggaggcgttacagaaagttgtcgcttcccattcccccgctaaccgtatcttattgctgatgggagagtggctggcgattcgccgccgcagcggaaagctttccgatattttatttcatagcctcaacaaccgcttaaatgatatgtcgtcagtgttggccggctgtgagcgcatcgccaacacgccggtgccttttgcctatacgttaattttgcatcgtacggtttatcttttctgcattatgttgccatttgcactggtggttgatctgcactatatgacgccgtttatttcggtgctgatttcttatacgtttatcgcgctggatgcgttagcggaagagttggaagatccgttcggtactgaaaataatgatttaccgctggatgcgatatgcaatgcgatagaaatcgatttactgcaaatgaatgatgaaagggatattccggcaaaacggataccggataagcgctatcaactgacctgagttcgtcttaactggcgcagaatgttcatctgcgccataacctgaaaagcaaagcttaatagccttctccaacgccggttttggctggaccggagtagtggacatgaacgattcgccatcctgtgtttggtatcttcgcccatacctggctttcgcggcctgtcgtgtgttgagtctgcccattatcacggcgtaccgcggtaaaatgccagtcgaactctgcaacggcggcattgccatacacatgaatagccgggggagcgtccagttttaacgtgcgtttgctgaacgttttacccatagtggtgccataaaaattttcagcgatctgcgaccatccgcgttcgtgaccgcgtggatgaataaaactggtttccggtgaaacataaaaaagctgcttgcctaacgttgggtctgccttatctattgaataaaggtaacggttaatgctttctgtaatttcttgtttaacggtcgacgtagcttcattttgtgcggcggttggcgttgccgctgatgccgatgacgccatcagagttaacgttatcgcggcggctgaaaaaaatagtgacgttttttgcataatagttatacccatatggtctgtttttgagacgctttatctttcctgttacgttcacctttatactaaaggagcatggctctcgaacaataaaaaacatccttctataaaactaccccgaaaagggagtagtgcaattaagaatatcgtatttgtttgtaacggcatgactcaaaatatcaacatttagagtttcagtattgttgttgtcccttgacttacttttatgtttattaccactggtaaatagttaatcttatgaatagtgatacacaaatgaccgtttgcgctatgtgataattaaccatagtaaaaatacgcgaagcgaagaagtgctatttcagtagtactgatattttcataacgctaatttaaaaataaatgtaaacgtaacaaattatacacaaaaataagaagggctgtggcctcaactgacttgattatgattccgtcttaatgaagtgtcagcagagtgttcagtgccattctcacctcggcatccccgaccgtaagccagttctctactggtcacccccttgttattacagcagaaaacagggcacaccattgatgtagccatgcttaacttgcattttaacatcactaatacatagcaagctaatattacactttgaaacttaacgcacggtaattgttagtgatattgtcccggacagttccgcgagcaggttttgcggaaagtccaaaaataagacaaataaggcatataaaatgaaaaaagtagtggtgttatctgcggtagccgcagccgtgatgatggctggagccgccaacgcagcagaaatctataacaaggatggcaataaactggatttgtatggcaaggtcgacggcctgcattatttttccagtaatcatagtacggatggcgatcaatcttatatccgtatgggtattaaaggcgagactcaaattaccgatcaactaaccggttttggacagtgggagtatcaggtcaacgccaatcgtccggaagatggtgactccagcggttccccgcaaagctggacgcgtctcggttttgctggtttggcatttgccgatatggggtctgttgattatggtcgtaactatggcgtgttatacgacattggttcatggactgacgtactgcctgaatttggtaatattacctgacgtcgtcagtctggcctgatgaactaaccatcctcgcgcggtttccactactgctattttccactcgccatcatcaaaacgattccagcgtagggtaggaagggcgctcaaacttcgggcgagcgtaatgcagcgggccagcagacgtagcgcagtcgtttttccgctaagacaacaggctgacagcagcggatattcgatagccagaggcgagacatccaggggaccatgggttattaacgtatggtccggggacgacgccatcggtagtgtaggtgtaatgatattctgtactgccgccagccagcgggcggtttcagaacgctcttgcaaaaaccaggcttcccagccctttacgccagcggcaagccaggtctgaggatcatcgtcaaaaaagattgtgcttgccagcggggataactctccgcgacgtaacaacgcccattcttcagcggttgcctgtcggtggctaaacagggggagccagtcggtcaacgcgcgacggagcgtttctcgcgccaactcttgttgtgcggcctgcatatctggcttctcttcaggaaacaacagtaaagccgccgctgcgttgtgcgcctgagcgcacaacgtaaacaaacgtgaaataagcgtttttgcgtataccggcgttgcgccctgtaacaaacgaccgatcggcgcctcctgccaggtaatccatagcgggtgagaatagacggtcaatctttgcacgaattattaccttcatcgatcaccataaacccggacttactggtttcgcaaaccggacagcaccagtaatcaggtaactggttgaagggcacgccgggtggaatttgccatacatcatcgcccagcgcagggtcgtaaacccaccaacatactttgcactccatgcgcaccactggctcattttctgtgaccgggtattctttcaaccattccaacgtattttttagccccgtgtaggcatcttcgatatcgtcgatgcctgcaacggcgatatcaggaatgtccgctatctcaatcatatcttgcagtaatgtgttcatatcattgaaataattgacccgccatacgccgggaaaatgcgtgcttacaatccggcatttaccatatccgcgtgaaaaaatagcgctacagccttcgcctaaaaaatgatccagatactcgcgatcggcatcgtttactggcaatagcgttaaattaatgatatgcggctcttttaccggctgttttacgcgctcggctatttcatgcgcgataaaggcgccattcatcaatcccgccagttgtggcggcaattctggtgtaatcggcggctgcggatgcgtctgccagatgctctccgggatcgggccaatgataatttcatcggcaacccgttgctggtcagcgttatattcacgtacacgccagacgcccgtaaaaaccgtctcctgaatacgctgttcttttccatcggataatagtacccgggcggagatttcaccttcgccgagcagttgatccaataaaccgctattctgttgctcagtggcattcagcttatagctcaggggaaaggggagcgttgccaccgggttatccatatcgcgaataagcgtagtcaggatgtgtctggcaacacggagctcagcgggcagcgcctgttccggtaaaaccggcgtcagcgggagattaatgccggcggggatgggaagaaagttaaagtcttcctcttctggctgcgatcctggtccggcaatattaacgactggaatagttctggaatgattcacgtgtgttacctttcattctattgcgtaataacgggaatatcctgacgatagcccggtgtagtcagcaatgcggccacccgctgagagtattcttgccagctatataatcccgccagactgccgacaaaacggtgctggcgaaagaaaagcagcgccggatatttcagaatgcgatactcccgggcgatcagttcactctgttcgctatccgcaaatgccgcggtataagatgtcgccggaaattgcttgaggatctccgggataatgacccaactgtcggcgacttccggatgtttgttggggtcactttgcagcaaaaccagcagagtcggatgcgcattaatcaacgacgggagcgtttgcgcatcggtaaccagaaagcctttatccgccagtggacaaacaggattttggggtgagatagtcatttttttaaatgctccggtaattcaggcgtgcgagacaataaatcggcaaaaccggtcagcggatcgctttgcgtgagcatggcctgttccagcgagtccagcgccaccagtacctcaacggcttccgcttcgtccatttctcgtcgcgctgcgccgccaaatgtcagcagccatgcgcctgctaaggggggagccacaagccgaatatcaacgtcgataagctcgccgtgtcggtcgcggcatttggcgaaccactgaccgggtgaaataacctgcacaggaacgccaatacacattatgatttctctctctgtagcacccgaatatcgccgacccggcaagcgctttgcgcatctggccgttcatcttcgtagcgttccatacacaggctgtaatgattgagtctttcagtgggcaaggccgctgaagaggcggtgataccccattgcgccagcacttcctgcgcgagatagaccgcaggcatcagttgcgcccttacctgcggcgtaagactcccgccatagtcatccagacattccggctgcacgccaatcagcacaatctccgataactggccgccggttaattgcagcaatgccagcacttcagaaaaactggtctgatgtaaactaagttttttcgccgtcagataggcgggaacctgttcatcacgaaacatcgccagcgaacctggcgccataccaaaatcgatagcatccatgattaacagtttttctgtctgttgcagccagggcagcagcgccagcccctgcgtaccgccatcaacaacgtcaactttctcgttatcggcatactgttcaaacagcttttccgcagctctgacgccgaacccttcatctgcccaaagcaggttgccaagccctaagattgttacttctgccattgttatcacctgaaccagcgccagccgcttatcatgacggaaatcacgctttgtcggctcataatgtcttcgcggatagcggtataaacatgcgcaatgacgaaggcgataatgaaccacatgcccagccggtgccagaaatgcagcgcgaggctatcgttgccagtcaggcgaatcatccagccaaaccattgatacgcccaactgtctgttccaagtccttcgccatagagcgcaaagccgctacacaccatcagtacggacatccagaaatagaacattaccgccagtcccgctaccggattatgtccatagtaacgatgggcctctttttcgaggaaaaaataccagcggatttcgctgataacgcctttgcgccaggcgcggcgccagaatggaaccagaaacatctccctggcgtactcattgccgacacatgcccagtaaatacgaaacagcagcgcgacagtaaaaatatacgccgtggtaaaatggatcagtcgtatccagcccatccaaaacataaaggtcgcttcaccttgaatcgatggcagggggcggccaatgaaatatcctgtaacagccaggacgacaatggataacgccgtgatccagtgccataaacggaccggcgcttcatagatatagtacccctggctggttatttctttgagatgcattgagacctccgaatcgtcgtcatcgtacctgaaccctgaccagctcccctccatgattatcaataacatgggtggagcaggccaggcagggatcgaagctgtgcagagtacgtaaaatcttcaatggttgatcgggaacggcgagtttagtccccattaacgctgcttcgtacgcgccaatttgacctttatcgtcacgtggcccggcattccaggttgtcggtaccacacactgatagctgtcgattttctgattttcaatttttatccagtgccccagcgcgccgcgcggcgcctcgctgaaaccaacgccttttgccgatgtgggccaggtatcgggttcccagagcgtaacgtttgccgtcgccgtatcgccggacttgaggttacgcattagacgatcgaagaaatattgcagcgtattgcctgcccatacggattccagcgcacgcgcggcagtacgccctaatgtagaaaagagcgcttctttaggcagctttaatacactaagcagttgatccactggttctttaaattccggtttattttgatgatatccaatcaaataacgcgccagcggacctacctccatcgcatgtcccttccagcgcggcgatttaatccatgaatatttggcggactcatccacctgttcgataaaggtttttgtgcctttatagtgttcgcccatgaccagttgcggttcggtcagaccatcccacggatgcaggcccttatcgttattgccgttaccataggtataccaggagtgagtgacaaactcctgaatctcatcgggggcggttaaatcgacaggatgaatttcgtcgaaacgaccgttaatgatagccccacgcggaagcagaagattactggcggaataatcgttagggttatccggaaactcgccataagccagcaggttcatgctcgataacccgccgccgatttttgcccagtctttgtaataactggcaatcagcaagacgtccggaagataaacttgttcgcagaactggcgagctttttggatgatggaactgacaaggttcaggcgctccatattcactgcgccgaccgcgcccgtttcgtcaaggttgatggcgcaaggaacgccgcccaccagccagttaggatgcgggtttttaccaccgaaaacggtgtgaatttttacgatctctttttgaaaatcgagcgcttcaagatagtgggcgaccgccagcaaattggcttccggtggaagtttcatcgccggatgtccccagtagccgttacggaaagggccaagttaaccggactcgataaaccgcttcagtcgattttgcaaatcgcggaaatatcccggcgaggatagcggccatgcggaaaggctttgcgcgatggcggaggtctgatgcgggtcggctttcagggcggcaactacatcgacccagtccagcgcatgcagatgataaaaatgcaccaggtgatcgtgaacgtgtagcgtagcctgcatcatattacggatacagtttgcgttgtccggaatcgcgattcccagcgcattttctacggcacggattgaggtcagcgcgtgtgtaccggtgcagacgccgcaaatgcgctcaacaaatgcccaggcgtctcgcggatcgcgacctttcaggataacctccaggccgcgccacatggtgccggtcgacacggcgttagtaatgacattattactgtcaatattcacttcgcagcgcatatgctcttcgatgcgagtaaccggatcgaccacaattcgccgtccgctattgtccagcgtaaaaccctgagtctgataaggatatgccataattattttttcttttccgtagcgttttctgatgacgtgttgtttttattgcgggcgtgttttatggcgctaaccgtggcgtgagcgatggcagcagcgcccgcgacgccggcaacgcccagtccgattttatcggcggtagcctcaatgccggtttgcggaatgcccgttgcccggctgtaaaaagaaccgtaatcccagaatccatcttccgaacatccgaggcatccatgacccgactggataggaaaagacacgccatcattccagcgaacggttgaacaggcgttataggtagtcgggcctttacagcccatcttgtacaggcaatacccttttctggcgccttcgtcatcccacgcttccacaaactgaccggcatcgaaatgcgcgcgtcggtaacatttgtcatgaattcgctggccataaaacattttgggtcgtccaagacgatcaaggggagggatgcgatcaaatgccagcatataggtgataacggcggacatcacttcaggtataggcggacagcctggcactttaataatggttttatcggtaattaatttgtgaaccggcgtggctttagttgggttgggacgggctgcctgcacgcagccccatgatgcgcaggacccccaggcgataatcgctttagcatccgcgctgacgcgttttaacttttccaggaacggctcgccagccagtatgcaaaacattccatcttcattcagcggcgcgttaccttccacggcaacgatataatttcctttgtactcacgcatcacatccgccaacgcctgctcggcttgttgccctgcggcggccataatggtgtcgtcataatccagggaaatgagcgacaaaatggcatcttttgccaacgggtgcgcagagcgaatgaaagattcggtacagcaggtacattcaagaccatgcagccatatcactggcgtacgcggtttattctccagggcataagctatctgaggaatcatcgaactgctcaggcctaaagacgttgcggtaaggctgcaaaacttgaggaagctacgccttgtcacgccgtgtctacgcataacttgataaaatgtatcttgtgtttgcataacgtttatcccaaaccactatagttagtgtgggcatcatatgttgcatttcttgtctttctcaacgtgttttagtagcaattatgtttctaattcgtaacaactgattacatgtgtgctactcacattactcaaaaacataaattaatttaatgttattggtgatgtggagtaaatatagcgttgtgaagatatctcttaatgttgataagaaaccgtgttttttatttataacatgatgggatttttttaaatggtcacacggataacgcgtttcatgttagttcgctgtgtttaactctcctttaaacccgtcagttaaatttattagcttgtaaaataagatcacaattaattacgtgctgcataaccattgataggtttaatttaatatattcatccaatccattttacaaacaaggagagcatgatgaaaaaaagtaaagcaatgttatttatcgctccggcgctgttttcatacgccatggctgcacaggcctgcacaacccttgctattcaggataaacaaggcgatatttttcatgggcgtacgctggaatatatgcaggatttaccctcatggttaacgtattatccggcgggaacgcagtttgataaaaaaacgccggatggcagccaggggataagctatcaggcgaagtatccgatactggccattacttccaccattactgatggcgatagcagagacatacttgaaggcatgaatagcgcgggattgtcatttagtgaaaacatgatcatgaatgcgcagttgccgccattgcccgcgagtgaatataaacaggcaattcctgtcacctcgttgggagaatgggcgctggcccgttttgctactgtcggcgaggtaaaacaggcaataaaagagggcaaattctggtcaccggaactgcatcggtttggcgatctgaaatcgccatttcattacgcgttttacgacaagaaaggaggaagcattgtcgttgaagtggaaaatggcaaattccatgtctatgacaatcccactcgcgtgatgacaaatggtcccgcattcccctggcatctgacaaatctgaataattatacgcaattaaccaatgtggaccgctcttcaggcacattgggcgggataaaagtgatgcagcctgatagcgggattgctattgcagacttgccatcgtccgatacgtcggtttcccgttttatacgcggcgtttattacaccacatatgcgccgcaagcgacatccgcccacgacgcaatgaatacgcttgcacatattatgagccgttttgatcgtccgaaaaatattacggttgattatatggggagtgaaggggaaggcaacgccacccgcaaaccggtctcagaatatacggtctggacaacgctgtctgacttgacgcacggtgagatgatggtgcgcggctacaatgatatcaactataaaacctggtccctttctcagtttaagaacgcgactgcgcccgtgttcgagaaaatcaacgtcaaaggataaaccgctcgtctctgtttagtttccccggtagtctcggcgaaggtaatggagactaccggcggttgcttctctttatcatgcacggtaattaattatcacgatcaccagcgccaggatggtatgctaaatccattcaaaatcccctggatatggattggagggcgcatggttatacctgaggtcaggcaggagaggctctatcagaagatagccaacctcatcattaagctgatcaatgataatatttttccaccgggaacttttttaccgccagaacgcgaactggcaaaacagcttggcgtgagccgcgcctccttgcgagaagcccttattgtactggagatctccggatggatcgtgattcagtccggtaatggggttatcgtttcagataaaaaacaccttgccagtgactataccatcgaagaaattctctctactcgcgagctggtcgatagccattgtgcgcgcttagccgcacaaaacgataacgttgacgtcatcaaccaaatagaggcgatttatcatcgtatggatcaagccattaacgataataacgtccacggcttttactcgctggataaagagtttcaccttgcgatctctgaggccagccgtaaccgggtgttgtttgatatgtcccgtatgttatgggaacaacggattaatatcccttacgccgggcttgatgaacagtctggagacagaaatgttttacttaatctcaacaaacaacataaagcgatagtggatgcgatgcgccagtctgatgctgacagcgcttatgagggatcgctggaacatttacgctatgtgagaaagattgtcggcggctaagtttgtcggtaaataacaccgcatggcggatatgccatgcggtagaactcgccgtaaatcaatggaaaacagcattaatctttaagtaacgctccggatagcgatcaagttctttaactgcatcagggatctcatcaagattgacgaccttactgacaacatcttgcggattaatctccagcgttgacagcatgcgtaatgcctcatcaaattcaccggcactggtgcgggagccgcgtaaatccagttctttgtaggtgatcaggttcgtcggcagcgacgtttcctgttttggccatccggtaaacgaaatacgaccagcaaacgatgctaaatcaagcgtatttcgaatagcgctatttgcgccggaggcttctatcacgacctgcgccatggtgccgtgggtgatatttttaatagcgtcgataacctgatcgtcagcggcgttcagtacataaggaacgccaagcttttgcgcatagcgtagcctttcttccacaatatcgatcagaataggcgttgccttgtaatgacgcgcgcttaatgccgccataagaccaatggcccccgcgccgatgatggcaacatattccccggccttaacgtttgcccgatgcagcgcgtgtagagcgatggtcagcggttctgccagcggcgccatttcagaaggcacattatctggtattttatgaattaaatgtgcgggatgagtaaccacctcctgcattgcgccatcgatatgcacgccaatgacatttaaattttcacaacaattagttctgccgacagagcaagggtagcagtgaccacaataaatataggggtcaacaatcacgcggtcgccttttttaatattgtccggcattccggtgccttcctgaagaacaattccggtcacttcatgcccaataattcttgggtaagtaacaagtgggttcgttccacgaaaagccccgatatccgatccgcaaatgcctgcggcatcaaccttaattaatacttcattttctttcttatggggataatccacccagcgggtttcaacttcaccaggcttattaatgaacacagctttgactttcattggctttgaatcctttactttttacaaacacgaagaccaacaggcttgaaacgatagcgatagcaccagccagatagaacgcatagtcatatttaccgctaaattgaacgataaaaccggtgacaagcggaccgataataccggatatattagccaggccatgcatggctccgccgacgctccctaccttatctttatgaacaacatcctgaataaccgcccaataaattgggcctgttaaatagagcaggaagagtgaaactgacatgagcgtaattgcgctaccaatagtgctaacggtaccggaaacggcaacacataccgccgcgcctgccagacatacgcccagaataagtcgacgtgagagcagggcattaccggtaatccgataaattacatcagaacagacgccgccgagcaccataccaatggcgccgatgacccagggaattaccgtggcgatactaatttctttaatatcgagatgtaacgaatggttcagataacttgggaaccaggtcaggaagaaaaaaagaatatagttgtagctgaaaaaagccagagttgtcgcccataccattggttgtttcatgtaatagccgagtgaaggcgtagcccggccatcatcagataaaataacgtcctcatgattttcaaaatcaatgcgttcttccggcgccaggcgtttactcattgttggcttatcgctaacgataaagtaccacagtagtacccagaccaagccaaataagaaaataatgccaaatgcggggcgccagcctaaggataacgccaacaggcccacaatcggcccggacaccgcgccgccgagcggggaaccggcgctaaaaattccgatcgccgtggcagactcctttcgggaaatccagttattgatgattttatttccggcagcgctgaccggtccttcagccataccgaaaagaacgcgcacgataagcattgtccacaatccggtgactaaaccagttaagccacaaaatacagaccatagtaacgctgcgatgagaaaaaccgtttttggcccaactttatcgctggcccagccatcaataaaattaaacagggcgtatccgataaaaaatgcgctgaagatcattcccatctccgcggcgttaaatcctaactccttttcgatcaagggggcagttatcgacaatgctgaacgatccatatagttgagcatgtaaactataaatagaagaaaaacgataagccatcccattgtttttcttttcatgattaatcctcttattgtggtctagcggcctgaccacaatattttaaggttattttcaaatcacctatcttgtggttagaacgtgatcaatataacaaaaatttatcgcagaggatttttatccatcgcaagcgtgatggataaaattatttaaaatcagacaattacttgaaaattcaatcggggctatcgttttcccctaatccacgccccggtaacgtttgacatgcggcgttaacggaaggtggtgctgtctgtgggtatttttcatcgggcgtaatataaacctgactcgtggcgacatagccatcattaaaagtggcttcgatataggtagcttcccaacctgtcttcggttcatttaacgtaatactgatcttattgttggcgggaatatctattgtaagcggctgatagcggatgccacaggcataacggaaatcacgcgcatttggattgttggctgtccagcgaacgacttttaccggcgcttctgagaaatagaccgtaagaagatggtggtgaataaggccgatcaactgcggtaatgtttttttactttgaaaccggttaataaatggaacgaggcttccttcagcgaactggttaattgagtagtggttcatattaggcactatacgtaatgattttacgccaggaagtttgctataataaaagcgagtattgtctggtacgaagaaatcatcgccacttgcattaataatatatttcggtattgcaaggcggggttggtaaatagtattgagatatcttaacggatctattatttgccttagctgggtaaatgtgggggattttattttctcatctatgccttgctggtagtaggggtagaatgtaatgggccaatttccaccgtatgattgataaatatgctcaagtgaagcatcaatatcaagtagatcaatggcgaagggaacaattgcttcaacatcaggatcggcaatagctgacaaccaggtggtccacccacgctttgaaatacctgtaatgataaaggaatttatattccattgcgttaactccttttttgctaatctcatcgcttgcgatatggcagtgaccataggaatatttaaaggcattaactcacgttgctccggcgcttccataaataatgcccagcttcgggaaacgctctcgtcctctttcagtggttttttatcatcctgaaaggttaaatattggttaggtatatcactcactgatattacgatggtattcgtatcacgggcgatgcttgccagtgtttgctgagtaaaatcaacgggtttactggggatttgtatgcctttttcataattaattccgttgtttacaaccaccaaagcatggtgctcttttgccgtttcagggatataaatatcaacgttatgtcgccattgcgcaggggttaccatgtcatctggcgaccagtgttgcgataataattcatagtgtctgactaccacctgtgctaatggagctgtactaattaaggtatattttagcggtgtgcctgaaatctgctcccggtagtcggggagaacatgagacaaatcacactccgggctgtttcgacaaaagaagatgttgttatgaagtagtgtataaacttttgtagaaataaaaaacagtacgataacaacgagatatatttttttcatgctttccccgcgctttacaagggcaaatgccaaccagcataatttccataaatacctcttaaacattcaatataagtacaatacttttgataaataagggaagaagggagtaataatgcttgtgacgttgtcacattattctgtttctggtttcgctattagcggtgaactttttgaaaggtaaatcattgccgtcaccagaccaataatggcgacagagatagctataccgatccagacgccatacagggcataacccaggacaaatccgcccaatacgggggatataaaatcagcgattgcgattaatgcctgcgccgttccgatgacgataccttgtcgggcaggcgatacatggacggacaaggcggcaagataagtgggtttggctagcgcatcagcgatgctaatacaaacgatagcaaaaataagcactggtatggtcgtggcgatacccgcagtgagaaatccagtacaaagaagggcgaagatgaggataattagctttcgctccgaaaaatattggctcacccaacctaacagaaatagctgaacgaaaatattaataaccccgtccgccattaacagatagcttaacgcttttggcccaaagggaagcccattccagatgaaggtgtcagaaagaaaaacaggtaattgtgaagagtacatgccataggcgaagaaatgacaaagcattacgatgattaagacgcgaaggactggcatctttaaaatagcgcgggcagagaacgacgctattttatctgtggtacgtgatgttgtggaagggtcttttaacccccaaatcgcgaccagggcagccccaaggacaagtataaaggcggcgtagatcggcgcacccagactgatacgcgatagccacccggaaacgcctgccccgacaataccgcctaaaccaatgcagcctgtgaggataccgattgcctggcgccgatttctgacgtgcgtacaatcggcaatataggctgcggcggctgacaaattcccggcgctaatgccaaaaagcgtgcgggcgagcaggataaacaggatacattgcgcgttggcgagtaatagtaaacttatcgccgcaatagccagcgtgacaatcagtattcgcttgcggccaacgcgatcggaaaggtggccaatcaggggcgctgcacaaaattggctaaaagcctcagtggcgatgatgattccaatgataagcggcgaaccgcccatctcgcggatataaaaaggcagtaccgacatcacagccgctgtactggcggcgtaaaggccgacaagcaggaaaacaggcaaaatacgccgcttgttgagcggggtgatagtttcgctgtcggtgttctcatagacattagtattcatctttaatccctatggcaaaacgagagagataattttcaatatcgttgctctgtttgccgtgaaagaatgcgccgacatagccatcgggtcggatcagcacgcattgacccggggccagatgataggactcccggaagtgccccagggtatcgatgagctcgtcctgctcgccaatgtgatgaatacgcagacctcgccgcgcatcgatgaccttaccgtgggtttcgtaggccaacagattccagtccggaccctggagtaactgaaataatcgtaatgattggccgccggcgcccaaaagaggagcatccggagctctttctcccgcttgtaacccatgctgacgttcgggcaacgtgtgggctaagggggagttggtatactggatgtcaagttgttgaacgtcgcgttctcgtttgatgccaccctgtttttgagagtcaagtaatcgggtagaaaggtggagcagtgattcggctaccgggcggcgttcctgttcatagctatcgagaagctcttctcctgcgccccgtagcgaggctgccattttccatccctggtaagtgaagcgtcagccacaagcgcatggattcccaacgtacggccggggaagctgacgcctaatttctttctgacaaagcttccgccgccatccgcgcctatcaaataatgcgcgatgatgacctcttctccagttggcccggcaacatacgcggtgaccgtgcgtggggtttgcgcaaaatgtcgtaactcgcagccgaactccacccgatgtccccatgcttttaattgctcccgcataatcgtttctgtcacgttctgtggaaccatcaatggcagatggtagggttcggcgtgggtcggttttgtattatgcgcaatatctgaatctacgtagcttccgtcatgacggtaggttcgtaatcggggatagagcccgccggcggcgaccactttattgagtatcccaatatcctcgaagatttcttgcgttcgcggctgaatacctttatcgcgggaaccggtaaaaggcgtcgctcttttctcaatcaggcgaaatgagaccccgtgacgcgccagttcgatggctaaagtaagcccggtaacgccagcgccgcagatcagtacatctgtagtggtgtatgttgtcatcgtctctccaatatgtgtattatgcacataagaggagacatgctatgtcagaaaataaaaatgtgcaagatacacatatttccgagcaaatgaaggcacttcacggtgcgttgattcgcgtggtgagcgcgctcaaccggcctcgtaatgatgagaaattaattgcagaggcggggattcaactcgatcgcgcgctattttcgatccttattagtatcgaacgtttagggccgattggcgttgttgagttagccgaacgtgccggtcgtgattatacgacggtaagccgacaggtcgccaaactggagaagttgggattgataatacggcaacataatgtcatcgatcgtcgtatacgcgaggccgttatctcccggacaggaaaggcgatgacggagcgtatagacgctgcgcgagagcaaatgggcaacgttgtttttaaagactggcctcaggataaaattgatatctttgttcggttaatgcaaaagtttgccgatgcaatggatagcgatgcttcaatgccggaataagcaaaagaaaagggcggtcaaatctgatcgtccatgctactgcattaattaaatagccagcaaagtaaatataataacaacatttatcgagttaattttcaccctttgaaaggccaacgtatactgcagaatacggctatataacaatcgccgtatcaatggtttttcaaagggtaaatatatgcttaccgaaaaatatgattttcgcattaccgatcagatgactatcccactcagacctcattggatagccaatgattcatacagggaaaagtgcaaaatgcttgtcctcaaccgaagtaaaggggaaattcataaggtagactttagtaaagtaacagattatatcaaagaaggtgatgtaatctgttttaacgacagtactataataaaccatatgtttatctgtaaaacaagacgaaatagattaattaaaattgttttagagggatttttactaaataatagagtaattatttccggacttttaaaagaaaggcttaacgcgaatgatgttttctatttggttgataaccctgaaatttccattaagatagagcaaaggtttggcgaggagagccagtaccgggccgttgtagaaaatcatgaggctttaatttgctatttagccagtcatggtgagcgtcttgatgagtatgtggactccagcttgttttataaatatccagatgcttaccgttccgttttttctaaaaagtatggctctttggaaataccttctgccggcattcattttacctgggatcttatccaaaaaatcaaagataaaggtgggttaatatcttttattactttacatgttgcatcaacagaaatgttgtccaacagaaaaatacaaacaaaatgtgtagaggaagtgactatcaacgaagaatactacgaggttccacaagctacagcggatatcattaatactgcgaagcaaaatggcggacgtatttttgccgtaggaactaccgttacacgatgcctggagtccgcgtattcgagggaacacaattgcctcaaagcaagttctggctggactgcgctttatatacatccaggctatcaactgaaagtggttgactgcctgctaacgaacttacatcagccaaaaacgacgcatatggtgttaactggtcagtttgctggggttgatctactcatgaaggcctatgcctcagaagatatccagtcatgtcagttcgatatgtttggtgattgcatgttaatcatacaggatgaagggcagggatgaataaaataaaaccggtacacataatgctaccggttttaccgagaataagcatcaggggattcgggcaataacctttatttcgaaatcaaagccggccagccaggtaacgccaacagcggtccagttaggataagggggataggcaaatatctcctgtttcaccgccatcacgtcgttaagttgtagacggcatcattttcacgctttccaacaccaatgacagttaccgtgataatttcatcttcgacgctgtagaccagtctgtatcctgcaccacacggcttaattttgtacttaactgcttgtatcgattaccaggaacgttaacagcgtgcgcaccagcttgccattgtctaattcaagcacacgacgaacaaatgtgttataacaatcctataaagtggttgcattgccaatgcataaagttaatttaatcaggaaattagagtatggatacagttgaagagcttaatagcacttatttttatgccggacgttcaaatctgactgctagtcagttgctgtttatgattttctgcgaaaacactgccaatcagttgggtgttcaggattttggggcgatagtgtctattgtggctggattgaatgttttgcctacgcggacaaaaccgcgtggtgctaagcatttgcttaatccgtttcgcaaaaacgatattcctcaggcgccggagttcacgataggtatgctcattgcgtctgccagggctggtcgctggttgtatgactgattcacgcttgggggctgctttccgttctccatcatcatggagcgcataatgtatattatgttaaatgcaccagaacaattaaaagacatgttaaggcggctggattcgtgcatgtcaaaaaacttctggcccataagtttgatcccttccctgccgtgacgctgcgcgaattctgttgatttgcacccgcttatcctgcacacgttttccttgcaagtcatgccttgagattcttagttcatgccttaaggattccagttgacctctttctctaatcttttttaattccagatcggaaagcgcagtaaggaattttacttccgcggctgatagtcccattgtaatcgcttgctcttcagaagaaagaggatttaatttaccataatccttgaccaactgctccgtagtccattcatgtaaaaacatatggttactataaataaccggatcaatacctaatagtgttgccgataattgagttgatcgctgtgcataaattgcaccttcaaccttacccagtaaggttcctatagctgacggcagatcgtaatccagaagatctacctctcttgttgtaaaactctttaaatctgtatcgtaaacccagacctctttttcgatgttattgaaattatcaagcaatgtttttaataattctttatttattaggatcttctggaatgtttcttcatttctcccaaagtgctcaagaaacgctaaataagtagcgtaatccatttttctatctttaaaaaagagctgacttagaaaagcggcagattgttcatgattgcgttctttatcaaaatccagtaattcaggaacgattagaaaaattggataatcatcatcaatagtcataaatgggatggcgcgaaatagattggaaacatgttcaagtaataccaatctgcgcatgcggacataactattatctggtggcaatgacaaaaatgaatgcagagagctaagagaaggaaaatgtaatggatcaaccattatgatgctatcaaaataaatccccagagatctaagatgattagatatgttataaccaaaccgttgaatcggaagtaataatcgataacttttagacgcccgcacttctgttataagcgccgcggcgtgagtatcccaaaatttatttagcaacacgattaggtttgtaagttgattatctaactcgggagagctaattagctctttcagaatgaatctacgtaattctttcagttctaaatttctaaatgcatatttatatttttcagaaaaagcgttttccatcaataaaacatattcattctgtatgctttttgtaatactactaccttactgaccggagctccattatgagtgcatcacaaaacaagaagaaaacgctgtcattgggtttagcgctaatcccagtcatctccatgttgttattgttgattatcggttacggcatcatggggctacgtatctattttgattgcagccttctttttaaccagcgtggtctccgtctgtaccggtacatcgtgggggtccgccgggacggttggcgttgcgttaatgggggttgccgccgggctggacgtgtcgcttgcagcagcagctggcgccgttgtttctggcgcttatttcggcgacaaaatctcaccgttgtccgactcgactaactttgccgcgattgtcgcagacactactctgtttgagcatattcagcatttactttggacgaccctgccaagtttcctgcttgccgccgtggtttatcttatcgccggacacagtaatatgctgggcgaggtggctacgccgcagcgcgttacggacatcatccactcgctggagtcgctataccattttaatattgttcttattttgccgccggtgatcgtactgtggggcgcaattcgcaaaaagcctgtcatcccattaatgttaagcgcctgcgtacttgccttgttcctcggcgtcatcatgcagggactgagcatcaaacagggactggacgctttcattgatggatttgatatcgccatgttcccacaaggcgcagaaggtgtgcaacaatactggttcggtaaagtgggattttattgagcgtcactttggcgacggcgctggaaaactgctgccgatgtgggtttctgatttcgattttgcctgcccgccagaggttcaggcggcattgcatcagcgaatcgagcacggcgtatttggctatagcgaacgtgatgaggcctattttaacgccctgcttcactggttttcgtcacgccaccagctcacgttaaaacaggaatgggtatgcagcgtggaaggcgtcgtaccagggttggcgctcttagtgcaaatgttgacgcatccaggcgacggcgtagtggttcaggggccatactatggctccttcgccaaaataatcacgcttaatggtagaaaactgctggagaatccccttagcgagtcgccggatgaaggctaccagatggatttttgccaactggaaaggctgtttcgccatgagcgccctccgctaatgattttgtgtaatccacataatccaaccgggcgttgctggtcggccaacgagctggagcaactgcttttattatgtgaagcttatgatgtcactctcatctcggatgaaatatgggccgatctattgctgccctgcgaaacctttacctcggtactgcatttaggggagcgctggcataaacgggtcatctccgccactgcggccagcaaaacgtttggcttatcgtcgttgcgaatttctaattttctcattcccgatcctacgcttcgccagcgtttcctgtctcgtctggacgctcatgggctggatgtctttaacgccctctccgttcaggcggcaactaccgcatggaatgaaagcagacagtggctggattcgctactggattatctggcggaaaaccgccgctggtttgttgaacaggcgacagagcaccttccctgggcaagaattgtcccggcgcagggaacctatttattatggatggattgtaaaaaactgggactggatgacgaacagctaaaatgggtaatggcggatgtcgcgggtattgctccttcaatgggcagcggctttggcccggcgggcagcggatttatccgtttaaatctgggatgtccacgtacctaccttgaaatggcaatagacggcctgaagcgaatatcggtgaagacaatcaaaggaataccaacaggcggatgaatttttcgggcggtaaactgacaacggtgttatttctgcggcatgatatcgcctgagcgccagtaaaaaaccggccattaaggccggttgggtccggagcgcagtttcactatcaggggcgtctgaataacacgatgctgcgcccggccagatcgaaatccatttcttcggtaatccgcattccctgctgcgcgtcatcggcagtcgtcagttcaagcacccagccgccttctccccacatcggaatacggaacggtacgctgccttcaaacggattgaaaagcagtaaggcgtcatgccagatccccgcttccggctgaagatcgggtcgactaatacatacgcctatcgtcgatccctcatcccattgttcggattactgcgcccctccgccggcgttaaaccagcggatctccagaccgtcacgccagctctcccggcgcagcaacggttgcgtggcgcgcagttgaatcagatgacgggtaaactcccgtagcgcattggcggtttccggcaaattatcccagtggacccacgatatttcactgtcctgacagtagccattgttattgcccatctgactgcggccaaactcatcgcccgctaataacatcggcgtgccgtgtgagaaaagtaaggtggtcaggaaattacgtttctgtcgctcgcgtatcgcattgatgccctcgtcgtcggttggcccttctgcgccatagttacaggagcggttatcattatgcccgtcattattatcttcgccattggcttcattatgtttgtcgttataagacaccagatcgttcagcgtgaagccgtcatgggcagtaataaagttaacgcttgaccaggagcgacggccgcgcaaatcgtagagatcgccggaacccagcaggcgtgcggcgaaatcatttgtgacgttgtcacctttccagtattcgcgaaccgtatcgcgatatttatcattccattcgccccaccctggtggaaaaccgccaacctgatagccgcccggtccgatatcccagggttcgccaatcagtttcagttttgccagcaccgggtcttgcgttaccgcatcaaaaaagccgcctctctgatcaaagccttccggctcacgaccaagaatggtgcccaaatcaaaacgaaagccgtcgacatgcattgactccgcccaatagcgaagcgaatccatcaccatttgcagtacccgtggatgagaggtattgacggtattacctgtccctgtatcgttaatataatagcgatgctgatcgggcatggtgcgatagtaagagaagttatcgatacctttaaatgacagcgtggggccaagttcattcccttctgccgtatggttatagaccacatccagtatcacttcgacgccggcatcatggaaagcgcgcaccatatcgcggaatccctgaataccttttggaccatagtagcgcgtcgccggcgcaaaaaagcccagcgagttatatccccagaaatttttcagtcctttatcgagcagatgctgatcgtccgggaaccagtgaacgggtaaaagctcgacggaggtaatccccagacttttaatgtaatccacgctggctttatgccccatgccctcaaacgtaccgcgtagaggctcagggatcgccgaattaagctgggtaaagccttttacatgcgtttcataaataatggcgttcgaccacggtatggaaggccgttgtctatcctcccagttagcctcagccggatcaatcacccgacatttaggcgtaaatggcgcgctatcctggtcatcaaaggtcaaatctttatcgtcatgaagtaattgatacgcgaaatgcgcatcgttccactgaatatcgcccaccagctcacgggcataagggtcaataagcagcttattggggttaaaacgatgaccattttccgggtcataaggaccgtaaacgcggtacccatacagcgcgccgggctgcaacttcgtgacatagccgtgccatatttcgtcggtatattccggtaactccagacgagcgatttcatgctccccactcggatcgtaaagacaaagctcgacgcgttccgcatgggcggaaaaaatagcgaaattcacgccttcgccgtcataattcgcgccaagcgtatggctgtatcctgatctgatttcaaaagccctgtttgttgtcattctctttctccacccacggtaaacgttgtcctgtcacggcacatcaacacataaactcagtcgctcattaaaaccagtacgccgccctgatgtgaggccaacgacaggcgttcaccaggcattaacctctcctgggtaagcacattgcgataacgacgctgattaagctgtccgggtataataatgtcggttcctgaccagaaaccgctatgcgattgtgataataagccgtcacattcggcgaacaccagtcggggcgcaacaacaatcagcgcatcatcatgattgactctggcgtaagcgatgaccttgtcggcacgctgaccaacagcccgcagcggtatatagtcgccaaaacggaagagctcatgattctgctgacgcaaacgcagtaaggcggcggtggcatactgattcacctgcccgtccagccaactctcttcgcgcgagaaaactcccggcgtcagttggtctaactgctgcgccagcgtggcgaaatctggttcgcggcggttgtcgggatcgacaaggctaaaattcaacgcctcgctcccctgatagatatcaggtactcccggcgcggttaatttgataacggtctgcgtcaggctgttaaccagtcctgcgcggatgaagggttgcaaggaacgataaaaatcctgcaaaaatgtctgattatccggcgccagtaaataacgggcgtaatcaagcattgccgtttcgtaagcctcattactgtccacccaatcggtacgtagcttcgcttcgcgtagcgctttctccacaaaggcttcaaagcgtattttcagcgcgtttaaacctgtttcgtcctgtggttgtagcatcgggggccagacgccggtcagcgcctgatatagcatccacgtatccgccgattttggcgcagtgccatcattcaaaaatttgacatgggtctggttcatctgccgccagcgggcaaggcattcgctccactgttccggcgcttcggtaagcgtatacaggcgtgctcgcgcatcctcgcctcgcttggtatcgtgggtcgacgtaccggataacgcatcaggctgtcgcgcctgtcgggttttcatctcatggtgaaagcgttcgatggagaagtgatgcgtgacgggctcggcgccgacttcatttaacgccagtcccatgttttgacgaaagaaaagcgtatcctctaccgatttcgccatcagcggaccggtgagttgctggaaccgaacgcgaaactgtgtcgcctcctcctggctggagacgggaacatcgccggtaagaagacggctcagaaatgtaagcgcttctggctgcggagggttttcaagcgtctttacccgttccacaatacggtgtaacaggcaaatatcggtcggcggtagcccttctgccgtgccgtaagtgcgatatacgggaaaggcaattaataactcgcgtaacgcctgccgaacgacgctctcttcctgtgcgatctgtagctcgctggcaatcgacagcgcaagcgcgagcagccgggtaaattccccctcaaaattgcgatcgaccatcagcaatttagccgcccgtaattccgcccgcatatccactggcgcgcctgttacggtctcgtaagcctggcgcagattgtctatctgcttatcgtcaaccagtacttccgccagcgaggcgatgaattcatagcctgtggtgccggaaaccggccagtcatcaggaagttgctcgcctttagcgagaattttttccacggtgatatagcacgccggtcccacttcctgacgtaaacgcgcaagataggctttcggatcggcaaggccgtcgatatgatcgatacgtaaaccgtcaaccgcccccgttctgaccagctccagaatcagccgatgtgtatcgtcgaagacgattttatcttccacccgcattcccaccagccctgtgacctcaaagaaacgccgatatgaaagcgagcgagcggcatcgcgccaagacattaatttccacggctggcgctcatgcaaatcagcaatagcggctttatcggtaagcgccagtatttcagcctcgcgcccctgccacgtcgctggcgcaagcggataataattatcataataggcgaacgtgggtttacccgtaacgggatccggcttgatcgcaatttctccgtttcccagcacggcgtcaaacgtgtcgcctaaaaaaggcagcgtcagtcggcgcgaccagtcaatatcgaaatggcgcgcgtaacggctctccttgccatattcaagcacgtcgcgccaccaggcgttttccagcgagctggccatgtgattaggcacaatatcgatgatcaatcccagaccttgtgctttaagttcagccaccagtctttcaaatccttcgcgcccgccaatagaaggctcaatctcattcgcatcggtgacatcataaccatgcgttgacgctttggtggcggtaaagatgggtgaggcataaagatggctgatacccagatttttaaggtaaggcaccagcgccgcagcgcgatcgaaggtcatgctattgcgaaactgaagacgatacgttgcagttgggatcatgatgcagactctccctgggctaagcggacaataagagaatgttgggaaagcgacccggtggattcattcggccaggcgaagagagtcttacccggtaaatcgggcagcaataccgtcgtggcgctaatattcagcgccagtgacagtgttcctcccggaaaacgccagctaacggcaataaacccgggcgcggtttgcaataccgttcctgagctctcacgggcagcggacaacagcggcacgatatgcttctggcgcaaaagcagtagttcgcgggtaaatgccagccacgctttaccctcttcactgtgctgttgcttccagttaagttttgagcgttgaaaggtctctggcgcattcgggtccggaacattttcccctgcatgatcggcaaactcttttgcgcgaccttcacgaacggcgcgggctaaatccccatggaaatcggtaaaaaaaagaaaaggacggctttcgccatactcttcgcccataaaaagcagaggaatatgcggtgaaagcagcaacgtggcgagcaatacttttgttcgttcagcacccgccagggttatcagtctgtcgccctgggcgcggttaccgacctgatcgtggttctgaataaaatccacaaaggcgaccgggggttgtccggtactttttacgccgcgaggttcgccggtttgcggtgagatttccccctgataagcgaatccttcggccagcgctcttgcgaggtgtttttccggggcatcagcaaaatcgttgtagtaggcctgggtctctccggtcgcaaaaacgtggacggcattatgaaaatcgtcattccattcggcggtaaacagcggcgcattgccatcctgatcacggggatgcagagaaataatattgcggctatcttcggtagtcagatgaatgggtctgtcggtaatgtcttcccgaatacgttgtgcgatttcaaccagcacatgcctggcgctactgtcctcaatctgatcgatagcgtcaaagcgtaagccgtcgagatggtattctgtcagccagtataacggcgcctcgatgatatagcgccgcacggcgtcgacatcataggcgataccatttccccacggcgtcatgcgctctttgtggaaaaacgccggcgccaatagcggtaaataatttccctccgggccgaaatggttcagcacaatatccaggatgacggaaagaccatacccatgcgcggtgtcaataaacgctttgaaatcatccggcgtcccataggcagaatgcggcgcgtaaagcagtacgccgtcatagccccagccgcgctcgccgccaaattgcgcaacgggcatcacttcaataacggtaacgccgagttcagcgagataaggcagcttcgctattgcggtgtggaaggtgccttccggagtgaacgtgcctgtatgcatctcgtacaccacggcctgctcccaacggctgcctttccacccggtgttgcgccacgcgtagctgcctggatcaatcacatatgacggaccattgacgtcagttttttgggcgcgggaagccggatcggggagcaccatgccatcgctgagtacaaagttatactccgtacctggcgtcaccccggatacatccagcgtaaaccagccgtcaccgctcgcctgcatttcctggtctttacccgcaagcctgagcataaccttttgctgaccggtggcccaaagacgaaagcggacgacatcagcggcgatatattcagccccccagcttttgcaaaaaatttttgaactcatttgtcgctccgtttaactcataacctctacagcatccgaaaaacaagcatagactatggggctaatttttacgtgacactgtcacttaacaggcattctttttcctatctgcgtgtaaaaccgtggaattattgtcgggattgctcagatataccgaagtgcgcggtatcgcctcgcccgtgttcgccagagccctgaacacgctgtagctggataacttctccctgctcccaggcgttagcccccttgataacgggatgttcaggcagatcctgccgctcgcgtttaatggcctgggtatcaatccccagacggcgatcccgatcggccagcagcgcggggtcaagctgcccgtcgccggtaaagcccatcatcagcgcagggatacccattggcagggttttatcccggtcggtatgccaggtgtgccaggtcttgccataagtattaacaatcttactcatcaacgccttatcagcgacctgcggtaagcctggcgccaccaggctaccggatttcacctcgtactggtggctgtgccacagttttttttcctcgggaggaagcgttttaaataaacgttcgctgataatgtactccacccccatcaggcgcgcgtttttcgtattgccgtcgtaaatcaccgcctgcatgacatcttcgttcaggacggtaacgtaatggtgcgcttccatctgtccgtttttatcaccgctataaaaatggaacccgtcaaggtaggtactgatggcatcgacaggtggtctggattgaatagccgccgcgcctgtttccagggtacgtaatttggcagatgttttttccccgggaataggcgtttgcggcggcgtattattggcgccgcatccggccagaaaaggaatgataaagagtgccagcggtaaaattttcattaggtctccatatagtgaaagggctctaatgaaaatagtgcaataccacgtgattggtagaagaaatggaagatgctatttgtgacggtgtcacaaatagtaaaacccgacacacaggccgggttttgatatcagtttactcttattttgagagttctttcttgatttcgtcttttattttgcttaattcactctgcgggtttttcttacaaagctcaacggctagcggcactgctgtcgtctcagtttcctggaaatcaacgtagtccccgcctttaaaatcttcatcttcattcagcacccagaaagcgactggcgccatcgtctgcggattgaggtcaacaaactcctggcagctcatacctttaggcgtaacgtttgttttagtagtatctgttgccgcattcacgctaacactggttaccagcgctgccacgataatacctgctgtagcaagggagaatttattcattgttgttgctccaataattatataaataacctctacatctgcgcgttaacccgttaatgtagaacgcagaaaataataccccacctctctcaggaataaagatcaccctccgtgatatggctattattgatatttacgttgactgattttgatgtttgatgaataaagcaacatggcgagcagattttagggcgaaaaagtagaccacgacaacagcaaatgacgagtatgcgctacgttgagctgatgaaagagaacttcgctctgacatgccgtcgcaatcgcgcgccagccagacacaaacggtgggcagaacaaacatcgtaaacagattgcctgtcagcatcccggaggcaaccaccagccctgtccaaaacggcttgcggtgtctacaccgctggcgaaccttatcagggctaaaccaaccactattgccccggtagtcatcagcaccgggcgcaatcgaatctacaatacaatttcatagcatttacagatagtcggacaatttcaggtttccgtaatcataaaaataccttttgcacacaaactgtatacttccagtagatttattgttatttagcactataactgcaagcagttgaatccaaagggtaataattcaggtattatttggagggaaatttatataattaagataaataaatgcttatcggttaagtgagcgacgtttaagttttgttgcaaccacggctttatactttttacgagtgctattttttttggctaattaaaaaggtaaagttaatgaaactatccgtaacattggcgtttttcggttacatgatggtatccagtatggcacaagctagcgatatcaatatgtggcgtgaacccaaacctgttgtgaaagagggtaaatattacagcttaatcatggatcgtggcgagttgcaaaaagcagtaaaaagcagcagcaataactatctcttttccgaaaaaggtgcaggagtgaagccgctggtattgatcggctctccggtagagattagcgaatttatgttgcaaaataaaactcgcagcattgaaaaccacattaaaggtctacctgacatttatatgggagtgacaaaatataaacccaaacaacgttttaccggcttatttccgctacaggatatattgactcaaactgttgatcaggtatcgaaatttgtgcccggtaccgatatcaccgatgcggtgggaatcccctccgacctaaaagcattacagcaagccattttggctatgaagcaaaaagataaaatcagcaaaaatatactgtacgtcaaatttagctacttgccggaagatggaatggtgaaagtaggaagcaaaacagtttcttttggtcgtattctggagaaaatgcagcagagtaatcgtaccctgcgtagataagcaggaagcaggcagtatttccagcttctggaatgttaaagctacaaaagttgtctggaggtaataggtaagaatactttataaaacaggtacttaattgcaatttatatatttaaagaggcaaatgattatgaccggaatatttgcagaacaaactgtagaggtagttaaaagcgcgatcgaaaccgcagatggggcattagatctttataacaaatacctcgaccaggtcatcccctggaagacctttgatgaaaccataaaagagttaagccgttttaaacaggagtactcgcaggaagcttctgttttagttggtgatattaaagttttgcttatggacagccaggacaagtattttgaagcgacacaaactgtttatgaatggtgtggtgtcgtgacgcaattactctcagcgtatattttactatttgatgaatataatgagaaaaaagcatcagcccagaaagacattctcattaggatattagatgatggtgtcaagaaactgaatgaagcgcaaaaatctctcctgacaagttcacaaagtttcaacaacgcttccggaaaactgctggcattagatagccagttaactaatgatttttcggaaaaaagtagttatttccagtcacaggtggatagaattcgtaaggaagcttatgccggtgctgcagccggcatagtcgccggtccgtttggattaattatttcctattctattgctgcgggcgtgattgaagggaaattgattccagaattgaataacaggctaaaaacagtgcaaaatttctttactagcttatcagctacagtgaaacaagcgaataaagatatcgatgcggcaaaattgaaattagccactgaaatagcagcaattggggagataaaaacggaaaccgaaacaaccagattctacgttgattatgatgatttaatgctttctttattaaaaggagctgcaaagaaaatgattaacacctgtaatgaataccaacaaagacacggtaagaagacgcttttcgaggttcctgacgtctgatacattttcattcgatctgtgtacttttaacgcccgatagcgtaaagaaaatgagagacggagaaaaagcgatattcaacagcccgataaacaagagtcgttaccgggctgacgaggttatcaggcgttaagctggtagtcgagggtgatttccgcattcagaacctgcgataccggacacccggcttttgctttctggatgatttgatcgaaagttgaagcatcaatatctgctaccgccactttgctttgtagcgcaattttggtaatggcgaagcccgcctccaccttatcaagcgatacgtcagcggtggtgtcaatggatgtcggcgtaaatccagcctctcccagcatgagtgatagcgccatggagaaacaggccgcatgtgcggcgccaattaactcttccgggttggttccctgcgcgccttcgaaccgggtattgaatccatacggttgttgattaagcacgccgctttctgttgatacagtacctttaccccgtttgatgtcgccttcccagtgtgcctgacctttcttatggattgtcatttttgctctcctgttggctcaaaaaataaagtatagactatgctgataatctgcgttgttcatgccgatggatgtagcatgttgtcgattacccgcacttcagatatagaaaatagttgtatgctttttcagtgatggatattaaaccaacaggcctccctttctttaaagaatatatccctccttttatccttactttttcttccggaagcgtattccattatgtatattttcattcatattaagatttatcttatctcgttgtaataaatgataaaaatcgcaataagtagcattttaaatgtatattaattgaccactatttgtatgaggatatgtaattggcaaacataatatattttcttctggggtaaacaattagagttccgccttgcgttaaaataactccaggactaatcttaaccacagccgcaaaaatatttgccatgctgaatacgaattaattttctgcgagccgtactaaataaatacatgttcacggaggcattatatgtttacttatcactcagcaaatacctcagcagcacaaccggccctggtcaacgcgattgaacaaggattacgcgcggagttaggcgttgtcactgaagatgatattttaatggagctgaccaaatgggttgaggcttccgacaatgacatcctcagtgacatctaccagcagaccatcaactatgtggtaagcgggcagcacccgactctgtaaaacctgctatgctgtatcggcaaccttaggggttacgtttctttcgcgtaagcgaatttgtccttaaaactagcaacaggattgaggagttaacatgaaatcgaaccgtcaggctcgtcatatacttggactggattacagaatttccaaccagcgtaaggttgttactgaaggcgacaccagcagcgtggtgaataacccaaccggcagaaagcgtcgcgccgatagccaaaagtaatcgtacagtcctgaaatgacgttaaacaccattgcatctgcaatggtgtttttgtttataggaatgaccttaacgtctcacaatgctttatactcagggtcggttccctggtggaaggcaatatatgatgataaacgacggtgccagggacagttattcgaaaaagagtgagcaacatggaaactacaaccaagaaagcacgttccctttatatcccttacgctggccctgtattgctggaattccccctgttaaacaaaggcagcgcttttagcgtagaagagcgccgcaacttcaatttgtcaggactgctgccggaggtcgtcgagtcgattgaagaacaggccgaacgcgcctggctccagtatcaggggtttaaaacagaaatcgataagcatatttacctgcgtaacatccaggataccaacgaaacgctcttttatcgactggtgcaaaaccatcttgaagagatgatgccggttatctataccccgaccgtgggcgcggcctgtgagcgcttctctgagatttatcgccgggcgcgcggcgtatttatctcttatccgaaccgtcacaatatggacgacattttgcagaatgtgcctaaccacaacattaaagttattgtggtgacggatggcgagcggattctggggcttggcgatcagggcatcggcggaatggggatacctatcggtaagctgtcattatacaccgcctgcggcggcattagtccggcctatacccttcccgttgtgctggatgtcggcaccaacaatcaacagttactcaacgatccgctctacatgggctggcgtcatccgcgcattaccgacaatgagtattatgcgtttgtcgatgagtttattcaggccgttaagcagcgctggccagatatcctgctacagttcgaagatttcgcgcagaaaaacgcaatgccgctgttgacgcgctatcgtgatgagatttgctcctttaacgatgatattcagggcaccgcagccgtgaccgtcggtacgttgatcgccgccagccgcgctgccggcagtcagcttagcgagcagaaaatcgttttcctcggcgcgggttcagccggatgtgggattgctgaacagatcatcgcgcagactcagcgtgaaggtttaagcgaagatgccgctcgacagaacgtttttatggtcgatcgcttcggcctgttgacggaccggatgcctaatttattgccgttccaggcaaaactggtgcagaaatgcgacaatctccagcactgggataccgaaaatgacgtgctgtcgctgctggatgtggtgcgtaacgtgaagccggatatcctgatcggggtttccggccagaccgggctctttactgaagagatcatccgcgagatgcataagcattgccctcgcccgatcgtcatgccgctctctaatcccacctctcgcgtggaggccacgccacaggacattatcgcctggacggaaggcaacgcgctggtggcaaccggcagcccattctcgccggtcatctggaaagataaggtttatccgatcgcacaatgtaataacgcctatattttccccggcatcggacttggggttatcgcttccggcgcatcgcgcattactgatgaaatgctgatgtcagccagtgagacgctggcgaaacattctccgctggtgaataacggcgaaggattagtgttaccagcgcttaaagacatccaggtcgtgtcgcgcgctatcgcttttgccgtaggcaaaatggcgcagcaacaaggcgtagcggtgaaaacctctgcggaagcgctgcaacaggcgattgacgataacttctggaaaccggaataccgcgactaccgtcggacttccatttaatacgtacccggcggtgaatgccgccggatatcactttcttctttagttttggtgagtctgtcgacacacctgaattcctttccctgcttatttgtcaagctactaatattagccacctttatgtattgaacgaggatttatcaggataatcctggctaaactattacattgtatttctgccgccttgcataactcatcagaaatattaatcctaaagaggtaatagcaccttacctgctattacctgctatgcagttcactattaagaaaaggagaaggttatgaaagctgctgttgtcacacaagatcatcaggttgatgttactgagaaaacgctgcgtccccttcgccacggtgaagctttgctaaaaatggagtgctgcggtgtatgccataccgatctacacgtgaaaaacggagatttcggtgacaaaaccggcgttattctgggacacgaaggcattggcgtcgtggcggaagtcggtcctggtgtcacctcgctgaaacccggcgatcgcgcgagtgtcgcgtggttttatgaaggatgcggacactgtgagtattgcaatacgggcaatgaaaccttatgccgcaacgtgaaaaatgccggttacacggtagatggcggcatggccgaagagtgtattgtcgtcgcggattatgcggtgaaagtaccggaaggcctggactctgcggcggcaagtagtattacctgcgcgggcgttaccacctataaagcggtgaagatttctcatattaaacctggccagtggattgccatctacggtctgggcggtctgggtaatctggccttgcagtacgcgaaaaacgttttcaatgcgaaagtgatcgccattgatgtcaatgatgggcaactgaaactggccgaggaaatgggcgcagatctgaccattaattcacgtacggaagatgcggctaaaattgtgcaggaaaaaaccggtggcgcgcacgcagcggtggttaccgcggtcgctaaggcggcgtttaattccgcagtagatgccgttcgcgccggaggccgcgtggtggcagtcgggctgccgccagaagccatgaaccttgatatccctcgcctggtgctggatggcattcaggttgtcggttcgttggtggggacacgccaggatctgaccgaagccttccagttcgcggcggaaggaaaagtcgtgccaaaagtcgctttacgtccgcttgaagatatcaacgttatttttaaagagatggaacagggacaaattcgtggccgtatggtcatcgatttccgtcgttaaacgatttgctgtggttctgccagaacgttgacgtttcagtcaccagcggatcgataacgaccagatacttcagtttgcttaagctttgcaccactttgtttttgtccgggaaggacgccaccgggttaaagccctgacagaaatagccggtaactttcccgctatccatcatgttgaaatatttgatcacatcataggactgatcccacttaggcagccaggcaaagccccagtcattctctttctgcgccgcatcgccatagaaagatttcatcaggctgacgaagaacttaggataattcccccagtagttgacctgatcggccagcgtcgctttgggggtattcgcggccagataagtttgcagatcggcctgtttttctgacggtagcgtcaggtagcccggcaggctggtggagagcagtcctaaatccgttaagccctgaatattagagtggccgcgcaaggcgttcacaccgccgccagccatccccatattgccgagcagcaactggatcatcgccatagtacggatgttctgcgccccgacggtatgttgcgtccagcccagcgcatacaggaaggtcgtagtgcgatccggcgcgctggtagaggccaacacctcacacaccttcaggaagtccgctttcggcgtaccgcagatgttttccacgacgtccggcgtatagcgcgaaacgtgctgcttcagcagattccacacacagcgtgggtgcgtcaacgtttcatcacgtttggcatagccgttttcatcgaactggtagttccaggaggatttatcgtactgacgcttttgggcgtcatagccgctgaaaagaccgtcttcgaacgtaaagtcttcccgcaccagcaggctggcgttggtgtaatgcttaacgtattcagcgttgattttgttattttcgatcaggtacagcaaaacgccggacagaaaggtaatgtctgtaccggaacgtattggcgcatagatatccgccaccgacgccgtacgcgtaaagcgtggatcaacgacaatcagcgtcgcatcgttattatttttcgcttccatcgcccagcggaaacccaccggatgcgcttctgcggcattgccgcccatcaccatcagtcctttcagggctggctttttctcttgatgtagactcggtcataaggagtatgccgtgcagacgttcactggtcgttgtctttgcggacaaagccattttaccgttgacgtcgaaatgctggatgtctatgcctgccattgtacgctgtgtcaaaaatggtcgggtggaatagccatgtatctggaagcctgcgggcaaccacagctagcccccctttccccggaaccgccatacttttcatcctcttcgcgcggcgaacgctacttctgttctggctgcgggtgtccgctgtggtttcggcttaccgataccgatcgctatttttccctggaccttactggaactgaacgaagttgatcgccgtcggctgattctggctgcggaaatttataccgaaacccagcctgccttctggcgactgacggggcaatacgcacgcctcagcggtaaagaggttgaggaaatagactccccctgccagctagcgcattaagcgcttatctcatcaggcgttatgttatcggcgttgggcttttgccaggctgaaccacatccctaccgccagcaaaagaagcatactcccggcgctgcttaacgccacgctatgcgaccagataaaggcgtgtctggcggcgtccagtattgcctgcccctgcgtgggcggcaggctattcgccaactgcacggcttctcccattgaagatgacgctctggcaatctcttgcgcctcaagcccggcaggcagacggatagacgcggagaagctacggcttaacaacaggccgaaaatggcgatgcccagtcccgcgcccagttcataagccatcgtttctatcgcgccggccgccgccgctttttctgccggcacagcggccataattgccgacgtggaagccagcaatgcgctggcggtgctaaatcccagcagcgccatcagcccccaggcctgccattgttgggtgctgaaatccgtcatcgccagaccataaaaactcagcgcgcttaacgccatgccgcccgtcgcgaccagccgtaaccccagacgcgagaccagcgcgcccgcaatcggcccgctgaatccactggcgaccatcaccggcagcataaataccccggcctcataaggcgatagcccgtgaacaaactgtagctcttgcgccatcagcagctcaaaacccaccagagtgatcatcgcggtcatcgccatcacgacgccgctcaggataatgcgatgggtaaatagtcgcatatcaatcatcggacgcgatgtcgcaagctgtgtgcggataaagagtcccagtagcaacgcgccggtaagcagggtaagcgagatgacccacagcgacaaattccctttcagcgcggttttagcgctatagaccaacagcaaaatggcaataatcagcatcaccgcatggccaagattgagcggttgatcgcgacggcccgcctgacgaggaacatagcgggcggttaagcccatgacgaccagcacaatcggcacgttgatcaggaaaaccgatccccagtaaaaatgctctaataatatgccgccgatgagcggcccaaacgccgctccgcccgaacctaccgcagcccagacgcccagcgccatgttgcgatgcttctcttcacaaaaggtggcgcgtatcccggccagcgtcgccgatacaatcatcgccgcgccaatagccagtaataccctggtggcgataagccaactggcggtatgcgaaaacgccgccgccagtgatgccaggccaaagagcgtcccgcccagcatcagcaggcgtttaaaaccgatacgatcgccaagcgcgcccatcggcaacaccatgccagccatgaccaaagaataaatatcaatgatccacagcagctcgttgccgctggcccccagtgtcatactcagtgtcggcgcggcgacatgcaagaccgtggcatcaatggcgacaggaatatagaccagcacaataatgactaacgttaaccactgacgaaacataactctcccttcaaaaacttaaacctggacacctgtccaatttcaggatcctacggtaagttgaacgaatgtccagctttttgttacactgcgcgcattggctaatgtggggaaaatatgagttaccttaaccgggatgaacgccgcgaagtgatcctgcaagcggcgatgcgcgtggcgctggcagaggggtttgccgccatgacggtgcgacggatcgcatcagaagccgatgtcgccgccggccaggtgcatcaccacttcagctcggcgggcgagctcaaagcgctggcctttgtccatttgatccgtaccctgctcgatgccgggcaagttccgccgcccgccacctggcgtgcacggcttcacgctatgttgggtagcgaagacggcggctttgagccttacataaaattgtggcgagaggcgcaaattctggccgaccgggacccgcacatcagagatgcttatctcctcacgatgcagatgtggcatgaggaaacggtcacaattatcgagcagggcaaacaggcaggagaatttacgtttactgctaacgccacggatatcgcctggcggcttatcgcactggtgtgcgggctggacggtatgtatgtgctgggtattccggaaatggccgatcccgcgtttaaataccatctggatcgtatgattacgcttgaactctttgcgtaaagttacaaataatttaataaaaatcgcttttaatttacaaatagtaacaattaagaaacatcatatctcctcttcgcgccgcgctggcctggttttttatctattctttcactcaatattctaaaaaaacttcaataagttctcaaaagagcgcgtgacgctctgtctcttttttgtgttttttttcaaatgatatgcgcatgtgaggggtaaaatgacacgacaaaacgagaattataaccgttatctcttgagtgactggcgacccgaaaatccagccttctgggagaataaagggaaaggcatcgccagaagaaacttatggatttcagtaagttgtttgctccttgcattttgcgtctggatgttgtttagcgctgttgccgtcaacctcaataaaattggatttgattttacgaccgaccaactctttttattaaccgcattaccttctctttccggcgcaatattacgcgttccctactcctttatggtaccactgtttggtggtcgtaaatggaccgtattaagtaccgtaatattgattattccttgcgcctggctgggattcgccgtgcaaaatcctgccacccctttcggggtatttatactcatcgctctgttgtgcggttttgcgggggcaaatttcgcgtccagtatgggcaacatcagttttttctttccaaaagccagacaaggtagcgcgttgggtattaacgacggactgggaaatcttggcgtcagtgtgatgcagttgattgcgccgctggttatttttttgccgatatttacttttttaggcgtccggggcgtgccgcaacctgatggctccctgctcgccctcactaacgccgcctggatctgggtgccgttactggctgttgcgacgcttgccgcctggtttggtatgaacgatatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtcacgctcattaattttatctttatggcgctgtttaccgccctgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacatcgcttgcgtcctgctgacctggctggtctacgggcgtcttaagcctaaacaacaataacaacatacgcacttgtaggacggccatccggtaatggtttaacgccaaatcgacaggatggcggaaaatttatcgaagcaggagaaatgtcatgagtaaactgttggatcgctttcgttactttaaacaaaaaggcgatacctttgctgacggccatggtcagatgatgcataccaaccgcgactgggaagacagttatcgccagcgctggcagtttgataagatcgtgcgctcaacccacggcgtcaactgcacgggctcctgtagttggaaaatttatgtcaaaaatggtctggtgacgtgggaaacccagcaaaccgactacccgcgcacacgtcccgatttaccgaaccatgaaccgcgcggcgccagctactcctggtatctctatagcgccaatcgtttgaaataccctctggtgcgtaagcggctgatagaactgtggcgagaggccctttcccgccacagcgatccggtgctggcatgggaatctataatgaacgacccgcaaaaatgccaaagttacaaacaggtgcgcggacatggcggctttattcgttcgaactggaaagagctgaatcagctcattgccgccgctaacgtctggacaatcaaaacctatggcccggatcgtgtggcgggtttttcacctattccggcgatgtcgatggtttcttacgccgccggaacacgttatctgtcattgcttggcggtacttgtctgagcttctatgactggtattgcgatcttccgcccgcgtcgccaatgacctggggcgagcagactgacgtgccggagtccgccgactggtataactcagcctacattattgcctggggctctaacgtgccgcaaacgcgtaccccggacgcccacttctttaccgaagtgcgctacaaaggcaccaagacaattgccatcaccccggactattccgaagtcgctaaactgtgcgatcagtggctggcgccaaagcaaggtaccgacagcgcgctggcgatggccatgggtcacgtcattttgaaagagtttcatctcgataatcccagcgactatttccttaactattgccgccgttataccgacatgccgatgttagtcctgttggatgagcgcgcagacggcagttatgtaccggggcgtatgatgcgcgcgtcggatctggtggatggactgggagaagccaataatccggaatggaaaaccgtcgcgctcaacagtacgggcgaactggtcgcgcccaacggttctatcggttttcgctggggcgaaaagggaaaatggaacctggaaccggtggcggcgggcgtcgaaactgaactgtcgctctctttactcggtcagcatgatgacgtggcgggtgtcgccttcccctattttggcgacaacgaaaacccacattttcgcagcgtgcggcaggaaccggtgctggtacgtcagttaccggtgaaacgcctggctctggcggacggtagcgagcggatggtcgtcagcgtttacgatctggtgctggctaattatgggctggatcgtggtctggatgacggccatagcgccaataattataacgatgtcaaagcctacacgccggcctggggcgaacagattaccggcgtgccgcgtcgacatatcgaaactattgcgcgtgaatttgccgagaccgcccataaaactcacggtcgttcgatgatcatcctcggcgcgggagtgaatcactggtatcacatggatatgaattaccgtgggatgattaacatgctggtgttctgcggctgtgttggacaaaccggtggcggctgggcgcactatgtcggccaggagaagctgcggccgcaaaccggctggctgccgctggccttcgcgctggactggaatcgcccgccgcgtcagatgaacagtacctcgtttttctacaaccatgccagccagtggcgctatgaaaaactgactgcgcaagagttgctgtcgccgttggccgatccgactaaatttaccggacatctgatcgatttcaacgtgcgcgcggaacgtatgggctggctaccctcggcgccgcagcttaatcttaacccgctcagcgtgaaagcgagcgccgataaagccgggctgtctgcggcggattataccatgcaggtgttgaaatcaggcgctatccgttttgcctgcgaacggcctgacagtggtcataatcacccgcgaaatttatttgtctggcgctctaacctgctcggctcctccgggaaaggtcatgagtacatgctcaaatatctgctgggcaccgacagcggtatccagggcgaagcgctgggttccagcgaaggaattaagcctgaagaggtggaatggcagtccgccgcgattgagggcaagctcgatctgttggtcacgcttgatttccgtatgtccagtacctgtctgttttccgatatcgtcttgccgaccgccacctggtatgaaaaagacgatatgaatacctcggatatgcatccgtttatccaccccctttccgccgcggtcgatcctgcctgggaatccaaaagcgactgggagatctacaaaggcatcgccagcgccttttctgaagtgtgtgtcggacacctcggacaggaaaccgatgtggtgttacacccgctccagcatgattccccggcggaactggcgcagccatttgatattctcgactggcgtaaaggcgagtgcgaacttattccgggcaaaaccgcccccaatatcgtcgtggttgaacgcgattatccggccacctatgaacgttttacctcgctgggtcccctgctggataaattaggcaacggcggtaagggtattgcctggaatacgcaagatgaagtcgatttcctcggtaagctcaattacaccaaacacgatggcccggcgaaaggacgtccgcgcatcgacaccgcgctggatgcctcggaagtgattcttgccttagcgccggaaactaacggccaggtggcggtgaaagcctggcaggcgttgggcgagatgaccgggcgcgagcacacccatctggccatcaataaagaagatgagaaaattcgctttcgtgatatccaggcgcaaccgcgcaaaattatctccagcccgacctggtcaggactggaaagcgagcatgtctcttataacgccgggtataccaacgtacatgaactgatcccgtggcgcacgttgtcggggcggcaacaactctatcaggatcatgcgtggatgcgcgcttttggcgaaagcctggtggcatatcgcccgccgattgatacccgcagcgtcagcgaaatgcgagaaattccgcccaacggtttcccggaaaaagcgcttaacttcctgacgccgcaccagaaatggggaattcactccacctacagcgaaaacctgctgatgctgaccttgtcgcgcggcgggccgattgtctggatcagcgaagccgatgcccgtgaactgggtattgaagataacgactggattgaagccttcaacgctaatggcgcccttaccgctcgcgcggtggtcagccagcgcgtcccgccgggtatgaccatgatgtaccacgcccaggagcggattatgaacattccgggttcggaagtcaccgggatgcgcggcgggatccataactccgtgacccgggtctgtccaaaaccgacgcatatgatcggcggctatgcgcaactggcttacggcttcaactattacggaaccgtgggttcgaatcgcgatgaattcatcatgatcaggaagatgaaaaacattaactggctggatgatgagggccgggatcaggtacaggaggcgaaaaaatgaaaatacgctcacaggttgggatggtactgaatctcgataaatgtattggctgtcacacctgctccgtcacctgtaaaaacgtctggaccggacgtgaagggatggaatacgcatggttcaataacgtcgaaactaaaccgggtattggctatcccaaaaattgggaagaccagcaggagtggcaaggcggttgggttcgtgatgttaatggcaagataaggccccgtctgggcggcaaaatgggggtaattagcaaaattttcgccaacccggtgattccgcaaatcgatgattactatgaaccctttaccttcgattatcagcatttacatacagcgccggagagtaagcatcagcccactgcccgtccgcgttcactgatcgacggaaaacggatggacaaggtgatctgggggccaaactgggaagagctgctcggcggcgagtttgaaaaacgcgcccgcgaccgcaacttcgacaacatacaaaaggagatgtacggtcagttcgaaaacaccttcatgatgtacctgccgcgcctgtgcgaacactgcctgaaccccagttgtgttgccacctgcccaagtggcgctatttataagcgtgaagaagacggcatcgtgctaatcgaccaggataaatgccggggctggcgtttgtgtatcagcggctgcccatacaaaaaaatctactttaactggaagagcggcaagtctgagaaatgcatattttgctatccgcgtattgaatccggccagccgaccgtttgctcggaaacctgcgtcgggcgcatccgttatcttggcgttctgctctacgacgccgacaggattgaagaagcggccagtaccgaacacgagacagatttgtatgaacgtcagtgcgatgtgtttctcaatccgcacgatccggcggtcatcgaagaggcgcttaaacagggcatcccgcaaaacgtcatcgacgccgcccaacggtcgccggtgtacaaaatggcgatggactggaagctggcgcttccgctgcacccggaataccgtaccctgccgatggtctggtacgtaccgccgctatcgcccatccagtcatacgccgacgcgggcgggttgccgcacaatggcaatattctgccggcggtggagacgctgcgtattccggtccagtacctggccaatatgctcagcgcgggcgataccggcccggtcattcgggcgctaaagcggatgatggcgatgcgccactacatgcgctcgcagacggttgaaggcgtgacggatacccgcgccattgacgaagtcggtctgagcgtacaacaggttgaagagatgtatcgctacctggcgattgccaattatgaagatcgttttgtcattcccaccagccaccgggaaatggcgcgcgatgcctttccggagcgcaacggctgcggctttacttttggcgacggttgtcacggctcggataccaaattcaacctgttcaacagtagccgtattgatgccatcaatatcaccgaagtacgtgataaagcggagggggaataatgcaaatcctcaaagcgattggcctgttgatggagtatccggacgacgagttgtgggaatgtcgggatgaagcgcttgccctaatccaacacgatgcgccaatgctggccaacttcactcgcgagctgctttatgcgccgttactggataaacaagcagaatggtgcgaagtgtttgaccgcgggcgcgccacttcattgctgttattcgagcatgttcatgcggagtcccgcgatcgcggccaggcgatggtcgatttgttaagccagtatgaaaccgtgggcctgcacctcaactgccgcgaactgccggatcacctgccgctctatctggagtacttaagcgtgttgccggaagcggaagcgcgcgagggattacagaatattgcccctattctggcgctactgggcggtcgtctgaaacagcgaggagcgccgtggtatcaactatttgacgccctgctgacgctggcgggcagtacgcttacaagtgacagtgtcaccaagcagattgttcaggaatcgcgggatttttcctgctcttcccgttcacccgtctggttcatgtctggagcgcgccgttcgagtatttcacccgtcgctaccagattgttcgtacccgccgctaattctctttgaccgggggtacgcttaccgggcaaagaaaaacgcctgggcgtcgtcattcggcaacgcacaggctatgatgattcttcagtcaaaggagaacatcaatgaaaccgcagatttaccatgttgacgccttcaccagcgaaccctttcgcggcaactctgctggcgttgtcttacatgcggatacgctaagcgacgcgcagatgcagctgattgcccgtgaacttcgtcactcggaaaccgcctttttgctaaaaagcgaagagagtgatgtgcgcatacgctactttacaccgacagtagaagtccccatctgtggtcatgccactgtggccgcgcattatgttcgggcaacggtactggggttgggaaacaccaccgtctggcaaacctcgttagcgggccgtcatcgcgttgaaattcatgccgaacacaacgactatcgcatcacgctggaacaaggtcagccctcttttgaaccaccgctagtcggagagattcgggctgccatcatcaccgcactgaacctgactgaagatgatatcgtgccgggagcgccaattcaggtggcttcaacaggacatgcaaaagtgatgatcctgctcaaaccagacgttgatattgatgccctttcgccgaatctggcagccctgacggcaatcagccagcaaattggctgtaacggcttttttcctttccagattcgtccgggaaaaaacgaaaccgatgggcgaatgttttccccggcgataggaattgtggaagatccggtaacgggaaacgccaatggcccgatgggggcatggctcgtccatcatggcctgatggcgcatgacggtaaaacgctacagattcaaggccatcaggggcgcgctttaggcaaagagggtactgttgatgttaccgtcaccattcgcgataaccagccggaaaacgtcaccatctccggccaggcggtcattctgtttcatgccgaatgggccattactttttaatctttgtcaggcccgcaaatcctcgcggcaaaaaattattttcccgcctccggatgggtatcaaatgcagccattaccgcggccagctccgcctcggtaaaaccgtgctttacatcatttacgccgagaccaaactgctgctgaagtaactgatacaacgacggtacatccggtatattgacctgttcaacggcatgtccctggtggtaacgcgtgaagtggaaattcgttaatgtcagcttgccgccatcaggcaaatggcggcacatcaacaaatgatgacgaaaatgggattgcggccagtgagccgaccagaaattgcccattacatgatcgctctgctgctgcacccccagatcaaaacagtacatcgactgccagtgctcatggtggcggaattgtaaaatccatgtgctcccctcctgtatcaggcggtattcgccatgcggcgtttgctgggcaatttcagcctgcagacgaagcggtgcggttagcgtttggccgccaaaccccacgtccgcgatccactgctcatcctcaacatcaaccagcagcaaacggtgcgtgcgcggcggtaaactggcgggatgagacagaatgacccgccccaataagcttcggacgttaaaaccgatgtcgcgtaacgcgcgttcaaacaggccattcagttcaaaacagtatccaccgcgtcgggcataaagcagtttctcctctagtgccgtctcatcaagctgtatttcacgaggcagtagcacatccagattttcaaaaggaatcgcgcagttgtgcgctaagtgaagcgttctgagcgcttcaaccgtaggaccccccaacggctgacaatttaatcgcgtaaaataagcatgtaaaaaagaggtcatctgaggcttccattaacattaatgcttgcgttcggcacacaggctgaggtggatatcgctgcgcaacaggataccctatccgtggaatagcgttggatacttttgaaaaaataagacaggccggctacagccgccggggtacgtagaattttggcgtataaacggaaatcgggttctgagaatctctttgcgacacgccgccaaaatagcggcgtgttaaaatttttaacgccagctcagcgagtctgatttctaacaaaactggctaaacataaacgctttttaatacttgtctaaatagttatggtaacgatcttttatgtcggccgcccgttgcgctttcgcctccggcatgtcgttggcccgatcggtataatattttaaactcggaatggcgcctaatgcctgaggtaaggcattatatgctgctattcgctctctgacggttttatatttttcatcaatatcataaccatagtatgctggcgcttcaaaaaagccctcttccagtctcatacagatatcttcaaaggaccccttaacctcaacgctatgttcgccatccgatatcctgacgattggctcacgtccagccatcagcgagagttgttcgaatgttaacatccgaccatcagaaagctcgacatctataataaattgttcatcacgtacagcatctgcaaggtgattatggatattccctgcattggcacagaactcatcaactttaggcgtaacattgcaataatgttcaattactcgcgtaaatccgtaggccagtcctgcggtaagcacatacaagatgcctttcatgatttttgttgataatttattttcataatctcctgcagcaacatgaggtagcttatttcctgataaagctctggcataggtagaaactgatgtatatggcatatcctgctccttcaaattttgctcaatagctttatatgtcctactcctctctcattatgacgatatgtcaatcaacaaaattgctcaaaggcatacattttcaggagaaaatgagaataacaggcgcaacggcctgatcttatgctgcttcaatatcgtcaggtggtttatcgttcgaggtcatatctatgaccataaatccctgcagggattaactctgattaattattgcgcaacgcaatcactgcggatttgtgctgaaagcttatctggctgaatcgtgaccacaccgcaccacatctgaccgcacaaataaacacgacatcctcattttgttctttccgtatgttttgcgtcatttaacaattgcaggtaggatgctccgccggcggttttatccctgtcacagaatcagggaaaagcggcattcgccattgcaggcaatcgattggtgagcgcccgtcgcggcataaggaatttttctgtcaggacaggctataacaggtaacgtaatgaaaacacagactacgcacgccgcagaacaacatgcggcgaaacgacgctggctgaacgcccatgaagaggggtatcacaaagcgatggggaatcgtcaggttcagatgattgctatcggcggcgcgattggcaccggtttatttttaggtgcaggcgcccgattgcaaatggccggaccggcactggcgctggtctatctgatatgcggcattttttcttttttcattttacgcgcgctgggcgaactggtattgcatcgcccttccagcgggagcttcgtctcctacgcccgtgaatttttgggtgaaaaagcggcctacgtagcaggctggatgtactttattaactgggcgatgaccgggatcgtcgatatcaccgcagtggcgttatacatgcactactggggcgcatttggcgacgttccgcaatgggtgtttgcgctcggcgcgttaaccattgtcggtaccatgaacatgatcggcgtaaaatggtttgccgaaatggagttctggttcgcgctgataaaagtactcgccattgttatcttcctggtggtaggcacgatttttctcggtaccggtcaaccgcttgagggtaatgccaccggttttcacctgattacagataatggcggctttttcccgcacggcctgttgcccgcgctggtactgattcagggcgtggtgttcgcttttgcttcgattgaattggtcggtaccgccgctggggagtgcaaagatccacagacgatggtgccaaaagccatcaatagcgtgatctggcgtattggtcttttctatgtaggatcggtcgtattgctggttttgctgctgccgtggaacgcctaccaggcggggcaaagtccgtttgtcaccttcttttctaaacttggcgtgccttatatcggcagtattatgaatatcgtggtgttaaccgccgcgctttccagcctgaactccgggctttactgtacggggagaattttacgttcaatgtcgatgggggggtccgcgccgaaattcatggcgaaaatgagccgtcagcatgtgccctatgcgggtattctggcgactctggtggtttacgtggtcggcgtgttccttaattatctggtcccctcccgcgtgtttgagatcgttcttaattttgcctcgctcggcattatcgcgtcgtgggcgtttatcatggtgtgccagatgcgtttacgccaggcgataaaagaaggcaaagccgcagacgtcagttttaaactgcccggcgcgcctttcacctcctggttaacgctgctgtttttattaagcgtgctggtactcatggcgtttgactacccgaatggaacttacactatcgcctcgttgccgctgatcgctattctgctggtcgccggctggtttggcgtgcgacgtcgcgtggcggagatccatcgcactgcgccagtgacggcggattcgacagagagtgtcgtattgaaagaagaagcagcgacataacattacccttccccggcagcctcaggcctgccgggtttaatgcgcgttgccgccaacaccgcatcgcgcccaatgcttagtcagccttaatcaactgcgccacatcattgctgttaatttcccgctggttgccttcctgatcggtataactggtcattcccgtctctttatctaactgcggcttaccctgagttacgatcgtttgcccattcttcgtcgtcatcacatagttggttgtacaacccgcaagcataaaaaacatcatgcccaaacctgagcatataaataactttttcatattttcctcgtgaatataatgagttaacgactgcaaaaaggtagtgtaattctcacagaatcatcaggctatcggcggggtttaacgaggcgtatcggtgcgtttaaagagatgactggaggggtttccccctccataccctatttacagagcaatgcgaataacatcatccggctgcgtcgcttcttgttcacgtgtcgatttctgcttcacgctgacgtagagcgttttaccgtctgccgatagcgccaggctattcgggtacgtcggcgtatcgaacgttttaacaacgttataggtcttcgcatcgatcacgctgacctgccctgcctgacggtgcgtcacatacgcctcgttacgtgtcggattatacaggacggccaaagaggcaggcgccgcgattttggcaagaatattgccattacgggtatcgacaaccagaacctcagttgccttcgagtcggtgataaacgcgcgatgacctgcggtatcgagactcagattaataaagaagtgttctttaccgtcatccagcaacttcttacgactgagaattttattgctggcggtatcgatggtgataaattcgccatccgcattggtggtgtacaggcgttgtgctttactgtcgagcgccagacccgtactcattttgccggtattttcgatcgtcgttttcagtttgatggtttcgccatccactacccaaatagcactctctttaccaacaccgctaatgtagatcgtgttggtcgccgcatcggcaaccagctcacggggctgtaacggacgaacctcttcagtacgtttgcgcgcatcaagtaccagacgaccttttacatcacccgttttggcatcaatcgcggtaactgcgctgttaatggtattgccaaaccacagcgtttgggtcgcggcattgatggtggcgccgaacggcttgagatcgttatgaatcgcttgcgtgatttccagcgtcaccgggtcgagacgataaactacgccgcctttatccagtttacggctttgcgatgtagccagccagagcgcgttttcttgctgactccaggccatctcataagcgcctttgcctaccgctttacgcagcatgtcttccgccgccagcgtgctaaatgaggatgcgacgaggagcgaacctaacaataaagaaccacgcaggcgcggcgaaaaaagatgacgtaagtgcatgacgactccttttgataaaaacgtgtatagctgcttcacactacttcgctgcgcgggatcttcgttccgcacttattataagttgagaataataatcattatttatcagaaagtggagcttttcctcgcctgcgaatgtcatggctcttaaataccgcacattttcttaacttaatgtgcgattaaaatttcaaaactttacatattgactacccttaatgtcacgttttccgttgatacgcttacatttatccggcattttcatgaaaattatttccgttagacagcgactttatcccgccctcttattgcctctgaccttctccccggtccttcaggccgccagcgcgcccaatgaacaaaccatgatagtcaccgcaacgccgcaaaccgtatccgagctggatacacctgccgccgttagcgtcattgagggagaagacatgcgtctggcgacgccgcgcgttaatttatctgagtctttaaccagcgtcccgggattgcaggtgcagaaccggcagaactacgcgcaggatctgcaaatctctatccgtggatttggctcgcgttccgcctttggcgtgcgcggcattcgtctgtatgttgatggcattcccgccaccatgccggatggacaaggccagatttcaaatattgatattaacagcatacaaaacgttgaagtgttacgcggccccttctcagcgctatacggcaatgcttccggcggcgtgataaatgtcaccaccgaaaccgggagacagccgcccacccttgaggccagcagctactacggcagttatggaagctggcgctatgggttaaaagccacgggcgcgatgggggacggcacacagcctggcgacgtggattacacggtatcgactacccgtttcaccacccacggctaccgcgatcacagcggcgcgcgaaaaaatctggctaatgccaaactgggcgtgcgccttgacgatgtcagtaaactttcgctgatttttaatagtgtggacattaaggcggacgatcccggcggacttaccgaatctgaatggaaagccgatccgcagcaggcgccgcgcgctgaacagtacaatacgcgtaaaaccatcaaacaaactcaggcaggattgcgttatgaacgtcagctcagcgcgcaggatgatatcagcgtgatggcctacgccggagagcgggaaaccacgcaataccagtctattcccctggtggcacagctaaaaccagcccaggctggcggcgtaattacactgcaacgccactatcagggaattgattcccgctggactcaccggggagaattaggtgtgccggtcaccttcactggcgggttaaactatgaaaacatgagcgaaaaccgcaagggttacaataatttccgtctcaacaacggcacccctgagttcgggcataaaggcgatttacggcgggatgagcgtaacctgatgtggaatgtcgatccttatctgcaaacccagtggcagcttacgcaaaaactctcgctggatgctggcgtgcgctacagttccgtgtggttcgattctaacgatcactatatcgcgcccggcaatggcgatgacagcggcgacgccagctatcaccactggctacccgccggatcgctaaaatatgcgttaactgacgcctggaatctctatcttgctgccggtcgcggatttgaaactcccactatcaatgaactttcttatcgcgctgacggccaaagcgggttcaactttgacctcaaaccgtcgaccaatgatacggtggaagtcggcagtaaaacgcggattggcaatggcttgttgaccgccgcgttatttcaaaccgataccgatgatgaaattgtcgtcgccagtagtatgggaggacgcactacctacaaaaacgcgggcaaaacgcgccgccagggcgcagagctcgcgttggaccagcgcttcgccggcgactggcgggtgaaagcatcatggacctggctggatgcgacctatcgcagtaacgtttgtcaggggcaaaactgtgatggaaaccggatgcccggcatcgcccgtaatatgggattcgcctcattaggttttatcccggatgaggggtggtacgccggaacagacgttcggtatatgggcgatatcatggccaatgatgaaaataccgccaaagcgccttcgtataccgttgttggactaaatacagggtataaatttaattacagtcagcttaccgtcgatatttttgggcgggtagataatctatttgatgaagaatatatcggttcggtgatcgttaatgaatctaatggccgatattatgagccagcgccagggcgtaactatggcgtggggattaatctggcatggcaatttgaataaatatccggcaatagcggggcatccccgctattgattagtcatagtttcatgaaagttacatgaagtactgatttttaatcgtcgctacgttttgttgcaaaacgttctgtaggcagtggcgactggcttctttatcaccagtcactaacgcattaagcaattttctgtacagattaacgccgttttgataatcatcaagtttaaaattatcatataaaaaatgcagacttggccccaggcgtacccataattgctcgatcatggcatacagcgttggcatatccgcgtagtggtagatctcaaagcggaatgcgcggttggccaaaagaattttctccataacgccactttccagcgcctgttgaaattcatctaatagcgcattcagcgtctgctcgcgatccggggtaatcttacccgcagcggcgaccaccgccatctcctccagggcagtacgaatcgtattaatttccagcaaactttccagcgagatctccggcaccataaacgcctgtgctggcgccaccgccaaagcactggaagagaccagccttaacagggcctcacgcaccggcgtaatactgacgcctaactcttgagcgatatttttagtgataagccttgcgcctggttttaatgcgccaatagacaattgatgctttaaccgattttcaacctgtgtggtcaggcttatatgttgtgttttttccgtacccggcattttccttccttcacctcttggcagaacaacatcgcaatcgagtcccgaagaagtttcggaacttaattgtaaaaaagataatccagacctgaacggccaaataaataaaagtgataatttacttgcgtgatattctcatcttttacaacaatacaggtttctttatggcaaccgttttatctccgtcattccttcatgtatcgagatttttgaccggttcaggccgctgagggagataagctgccccaccgcgatctgaatgatgaatataagtaaagccgcaattttaaaatttgcacatttttatggcgacataatgccgccattttttctttacgcatcgtccgctaaacgtatcacgactttgccaaagttcttccccgccagcagccctataaacgcttctggcgcattttccagcccatcagtaatctgctcccggtaatgtattttcccttctttgatccaacgccccatttcttgctgaaactcatgtatccggtgaccatagtcctggttgatgataaaaccttgcaggcgaatacgctttttaagtaatgtcgccatcagcagtggcagtctgtctggaccgtccggcaacgttgtcgcattgtagccgctgaccagaccgcagagcggaatccgcgccgacgtattcagtagcggtaagacggcgtcaaagactttaccaccgacattctcataatagatatcgataccctgcgggcaggcctgcgcaagctgttgtgggaaattatcagcgtgatgatcaaggcacagatcaaatcccaaaacgtctgtcgcatgacggcatttttccgcgccgccggcaatacccacgacccggcagcccttcagcttgccaatttgcccaaccgttgcgcctacggggccggtggcggcggcgacaaccagcgtttcgccctctttcggctggccgatatccagtaaccccatataggcggtaaaccccggcatccctaaaactcccaacgaccaggaaggatgttgcggattatcacccagctttaccaacccttcgccatctgaaatgtcataatcctgccaaccattgtaactcaacacccattcgtctggtcggtaatcaggatgattcgacgcgacaacgcgactgaccgtaccgccaaccataacgcagccaggttcaactggcggcgcataagagggttcatcgctcatgcggccacgcatataagggtcgagtgataaaaaaacggtacgcaatagcacctgcccttcaccgggcgtcgcgacgtcatcttcttcgaggcggaagttatccatctgcggcgcgccgtggggacgcgaggccaaaacccaacgacgatttcggttggtctgttgcttcattctattctcctcatgcctggcataatccatcaataatagtcgaacattagctttctgagggagttaaacactctcagatatcaggctgtgcgcttttatgaacgactttctttcccctctcgctaaatatgaattcttgcgctaattcgttgatttatgccgccttcaatagtatttctaacactatcgtaaacattccctggggttccctatgacgattcgctttgccgataaagcagactgcgccgcgattaccgaaatctataaccgtgcggtattacatactgcggccatctggaacgatcggacggtcgatacggataatcgccttgcctggtatgaggcccgtcaattactgggctatccggtgctggtaagcgaagaaaatggcgtggtgactggctatgcatcatttggcgattggcgcagtttcgacggttttcgctataccgtcgagcactcggtttatgttcatccggcgcaccaggggaaaggactggggcgaaaactgctcagcagactgatcgacgaagcccgacgctgcggcaagcatgtgatggtggccggtattgagtcacagaatgccgcctcgatacgcctgcatcattcgctgggatttaccgtcaccgcgcaaatgccgcaggtcggcgtaaaatttggccgttggttagatcttacgtttatgcagctccagcttgatgaacacgccgcgccggacgcctgctgatgaaccagtcgctgacgcttatctttttgatcgccgccggcgtcgggctggtggtacaaaacagtattatggtgcgtattacgcagacatcatcgacgattctgatcgctatgctgttgaactcgctggtagggatcgttttatttgtgacgatattgtggtttaagcaaggcgctacgggcttcggcgagctggtcgccagcgtgcgctggtggacattgatccccggtttgctggggtcattttttgtatttgccagcattagcgggtatcagaacgttggcgccgcgacgactatcgcggtactggtcgccagtcagttaatcggcggactggcgctggatattgcgcgtagccacggcgtcacgttacgcgcaatggtcgggccggcgtttggcgcgctgttgctggtcattggcgcatggctgattgcgaagcgccagttttaatgggttacaggatcgtgccgcctttggtgagctgttcgcggcgcgcgtcccgatcttcttgatattgcctgccgtgatgcgcgatagccgtgcgtaaacgctgctgctgcacataacgatcttcgtgacgtaattcagcgtcatcgctcaaggcaatcagcaattcattcatatgggcaattacgctctccgcgatggcggcatccacgcgggcgctcacttcctccaggtgcgacataagctctcctactctttattctgtaatagcatgattcgcctattatacgcgttattgtcgcccgatgcggtcattcgccgccgccactctgatttaacttacgtcaagtgaaaacacggggcttaatagaccgagaattcgcgcctttttgcctttcttccgccgtttgcttgcgtatagaccccgtaaagtagacgcgtgaagaagtctaagggataacaacgtggcaaaatctctcttgcgcagcggcaatctggatgattatcaggccgtgggcggcggcggtcaggccgtatttgaatcagcattgcaaattcgcgaaacgcttcgtctgcgtaaacagcagacgatggttgactgtctggcgattccgcaacttaacgataatggcgatcgggttgactggtattcgccgattgaaggtcaggcgatagcgtggaaagcggctgacgaagagacacgttctcgggctttacgttatttagccagcacttttgaaagcgcggctgcactcagtcgcaaaagtctgcaatccggtaaaacagcgctccagctatttggttcgctacttgagaaggcgacgcaatttcccggcgaaaatcatgttttcctggttaacggcaaaccggttatcaccttctggggattcgttaatctcaacgaaaatacacgcgatgatgtgctggactgcctgcgggtaaccgaggcgatctccgacatccctctggtcgagccggagccgcagcccgaagaaaagccgctggtagaggcggcgtttagtcaggcggatgaacctttgttaacgtctgtcattgagccgccgaaaatgccggaggaacctgctgcgccgcccgttatcgttagcgagccgaagcctgccgcacctatcccggttgctgaggcgaaaagagctcgccgtctaccgctgtggagcttacctgtcgctgccgtggttatcgccgccgtcgccacgccttttttctggccatcttcatccgttgacggggcctctcctgttcgcaccgcgcctgtcgctaccgcgaaaactgatgttaccccaatgcctgaactcaccgcgcatttgccgctgcatcgcgctgaggtgacgtccgcccccaaagcggcgccgctgccggaagcgcctgttatcattgccgctatccccaaagacgcgctggtgatggacaatacgcagatgaagcttggaaccacgcgctttttaaacggtagctggcgggtcagcgtggatgtcaaagatccgattaccggcaagccgccctctctgcgttatcagatccaaaataacaaaggcatcgcgcgcgtagtacatggcgataacgtggtttgtcgggcggaaattttctctggtctgcatcaaacgggcgagctgatgattaaaagtcgcggcaatgcgcgctgcaccgacggttcacgttatccgatgccggaaattacctgtaaagcaggcgtcaatgacgtcgcaacctgtaccgcccgttatggcgaccacgcggcaattccgttgacgtttaaaaagataggtgcctgattttatgttggtcaatctgtgtgattacaaacagagcgtcacgctcattgcaaacagtggcgtccagtttcttgattttggcttaacgccgcaagagtcggcccactacggacgttttgtgcgcaaaacggcaaacggcccgctactgcgcctcgattttgatctgaccagcgggcgctacacgttgccaggacgtgctggcggccaacccgaagtcgtgaaaccggaaagcactcagacgctgcactattctctggatgtactcgacgggatctggcttcccctgccgttcctgcgttttaatccgccgcgtacctttattgacgggccggataactgggcgcgcattcaggtacgtaaactcagcgagccagatagcgccggaaacacacaccgcatcaccctcgccttcgacagtcagctggcaaaaaatatgcctgcggcgttggcgccttgcgaaaacgatctgctcaatggcacacgttttgcgctcgcctggcgcgatgaagaagttgccgattttcttgaccagacatggattgacggctggctgcgcgagtcgtttcttcagtatgcctcacaggtggaaaaccgtccggaacaggccattcaacaagcgctgcgtagttttgagtatcaggcgcactggttgaatttactgacgctgttaggcgaacagcttacggtgccggaagtaaagtttgtgacacatacgttaagcacgcccgcaatcccggtcgatctgattctggatgtcggcaatacgcatacctgcggcgtcttgatcgaggatcatggcgatgcgaatgacggcttacgccagacggcagagcttcaggtgcgttctttaagcgagccgcagtatctgaacgatcctttatttaccagccgggtggaattctcagaagcgcgctttggcaagcaacacttttctgtcgaaagcggacgagacgacgcctttgtctggccttctattgtgcgtgtgggcgacgaggctcgcgcccttgctatgcagcgtgtgggcaccgaaggcagcagcggtatctccagcccgcgccgctacctgtgggatgaaacccccgccttgcaggactggcgctttagccagatccacggtaaaacgcagcgcgaaccgcttgccaccgcgtttccgctgatgaatctgatgaacgacgacggacagccgttattccgcctgccgcatgaagaaaggctaccggttttttcgccgcaatacagccgtagcaccttgatgacgcatatgttgtgcgaaattctggctcaggcgctggggcaaattaacagcgtcgccacccggctgcggctcggctttcccgcctcgccgcgccagctacgtaccctgattttaacgctgccttccgccatgccgaaacaggagcgagaaattttccgccagcgaatgtttgaagcgctggcgctggtctggaaagccatgggctggcatccgcaggatgaggatttcaccacgcctaagcagcgtgaaaaaagcgtggtgccagtacctgaaatacagatggaatgggacgaagcaagttgtggccaactggtatggctttataacgaagccatttcgcattacgccgggcgtaccgaatccttttttaatgcgctggccagaccggatcgccagcctgaacccggcgtcgtccccggacgcgcgttgcgcgtggcatcgattgatatcggcggcggcacgacggatatggcgatcgttcactatcagttagatgacggcgtgggggccaatgtaaaaattacgcctcatctcctgtttcgcgaaggttttaaagtcgccggggacgatctgctattggatatcattcagcgctgcgtactcccttccctgcaaacggcgttgcaacgggcaggcgttacggatgccgccgccctgctggcgaccttatttggcgattcgggacgaattgatactcaggccattttgcgccagcaaacggcgctgcaattatttatgccgctgggccacgcggtactttccgcctgggagcaaagcgacattaacgatccgtttgccggtttacatgcgacatttggcgatctgctgatccgccgcccaacgagcaacgtgatgaactatatccagcaggcgatcgatcatgccttaccgtctggttcgccgacatttgatatattcaatgtgccattgcaaatccagtttagccagcttcaggaggctctgctggccggtcagtttacgctgacaacgccgcttcatgcggtctgcgaagcgatctcccactatcactgcgatatcttgctggtgacggggagaccgacctgtttacctggcgtacaggcgctcatccggcacttacaaccggtgccggttaatcgcattgtgtggatggataagtatcaggtacatgaatggtatcccttcagtcaacaagggcgtatcggcaatccaaaatccactgccgcggtgggcgcgatgttatgcagcctggcgctggacttacgcctgccgcgtttcaattttaaagcggctgatatcggcgcgtattcgactgtgcgttatctcggcgtactggataataccgttaatacgcttcgcgatgaaaacatctggtatcacgagatcgatttggataaacccggcgcaacgctggacgcacgcctgcattttccgctacgcggcaacgtgacgttgggctttcgtcaacttgcgaacagtcgctggcctgcgaccccactctattgcctgagcattaattccgccgaactggcgaaaaccatcgctggcgacggcgtactgaatgtccgactgaaattacgcggcagtagcaaagatagcgccccggaatcgttcatattaagtgatgcctggctccaggacgggacgccggtcgccgccgatgcgctgacattaaaattgaatacgctggctgaccgccgccacagcggcagccactactggatagatagcgggagtgtatacctgaaatgacaaaaccgttaaacgccactcaggctgttatcgagtgggttaacaacacgcgccgttacgcaacgcgactggatgacgaagccgacgctctgctggcgcaacttacgcttgccgcggcggatgagtcagcgctcaacgccgcctgcgcatcatcacatggctgcgttggtctgtacgggtatgcgcaatccgcaaaagcgcatctgttaacgacgctatgcggtaacgagaatggcaagctggaaattatcacgccggaccgtgactatgattatttcagccacatcaatccgggtcatgcgccagcgaatatggctattcgctttacgcgcgacattttttcaaacgagagcggctggccgttgcgcctgcgcttgatcagtgaagccgaactggtgcagatctttattgcctggaccagctcgtcccccgtttgtcgccaggtcgaaaaatccattatcacatcacgcctggagaaatggcaatcgcttcgccaaccgcagcccgtccccggcgttaccgctgaagaggtagcgaccatcgcgagtttctggcgctcttgcctcccgtccgccagacaacatattgatgatgcgacatggcaacactttgcctcgctcttgcctgcgctggatctcacgacacgggcgcacgcctgggcattactgtggggagagcaaccagagatcacccagcaatggctggcgctggcgcatatgttgcaacaaaccggccatgccggggaactggcggcgccgctcagcctgctggtcgatcattttggcttaccggcggaaaacttcctgacgcaaatggcgctaaccgccagcgatacgcaaagcgatgtggtggtgcatccggttaaggaaggccgactgctcaatgcggtcagcctttcgcttgattctctggcgctgcttacccgcgaactggtgctaaccgttgaaaatagcgtactggataacgttgatttactggatattccggtcgcgccagacagtcatcctcatccgttatggcgggcgaaattaggctggatgctggcccattaccgtcagcagatacagcccgatgttctggtgatttgcaatgctctggcatctcgctcgcaaacgtccactgccgcccgtcacttactggagtgggttaacgccacgcagccgcagcatgaatcagcgttacccggcgtcgtctgggctattactccacaggatgcccgttttgccacccagcaaaatctggatgaagccgtccagcagttgatgggtaaacctggcgtgcattggggaacgttgcaggcgctggataaacacagtatgcagcgtttggtggagtggttatcgcaggcgacatcggcaccacagcgacaggcgcgcttacaggcgttacgcgaacaactgcgaggccgcgtgcgcgatctgttaccgatgtgtgatgacgcgcggctaccggttgaaaccgtgatccggcgtcttcaggcccaggccgccagacatggcgacctgctggccgggctgttaccgccggtacagaatttcgaagcgttgctgcgcacccgacagtcgcgagaagaacaggtcagcggtttatttaatgacgcgatcgatctctttgccgacgaaccaacgcacgcttcagcgtcagaaggtcatgaaacaggctaccaggcgcacaaaatgtggatcaatcatctgcgccagtgggcccactgccgggataatgcgcagcgtctgggactggaaccgcagatgctcaacgccgtggcggagattttaattaccgccagctatcgcctcggtttacctcagcagttacagaaaaccatgcagcgcgaggaggtgagcggcgcgcagcttcatgccatcattggtaacttcatcgcctggctcggctacgccaatatcgaggaggcccaacgcccggccagccgcgttcagaaaggcgcagccattttcgccgcaacgccgcgttcgacaatgttgcgtctaacaaagcttgacgaacagcccgttcacgccgccagccgctatgtctatgactggcttgttgcgctgtataccctggccaatgagaacgcaggatatcggcatccgcaggacgttaccgacgtagacagagcgcaattaattgccctgatagcctgacctggcggaaaaaccatgcccggtaacctgtatcgggcttgaggtcagaaaagcgaaaacagcaatgcgacggggaaacttatcggccatgtcgcgccaaccagaggaaaaaacgcgcgcaatatgctctttttatttgacacacatcaaggtttatcagccttaacagcaaaacgttctcaatgcacggctccgctcacagaatatcctgtttacgtattattgcggatctcgccaacccgtactatacccataggggttatgatgaaaggtggcgaaaatgaatgtttccagtaaaaccgtcgtgctgattaatgtctttgctgctgcaggacttttgggtctgatctcgttgagattcggctggtttgcttgaggtgttcaacctttgagtacttgctgcgcatgttggcggggaggtccccctctccgccgacacccgcctattttttcacgatttttctgaacagtaaatgatccttaatgcttaaccatgatgtggcggacaagggtgtagtcttccagaccatacaatgacatatctttgccgtatcccgactgtttttgccctccatgcggcatttcgctaaccaacatgaaatgggtattaatccaggtacagccatactgcaatctggcgctaagccggtgcgcccgcccgacgtcctgagtccagacggaggatgccagaccatagcgagaatcgttggcccacctcagaacctgatcttcatcatcaaagacggttatactgaccaccgggccgaagacctcgcgttgcacgatggcatcttcctgttttgcgtctgccagcaacgtcggagcgaaatagtaacctttaccttccgtttgacttccaccagtaatcacacggatatggctgagggccttcgcctcctctacagccgctgtgacgcgcttcaggtgcgccagcgaacttaacggccccagctctgtcgacttatcctccggcgcgcccattttcaggctgctcaccgcgttccctagcttttcgaccagcgcatcatagataccgcgctgcgcgtatatacggcacgccgcagtacaatcctgtccggcattatagaaaccgaaagtccggacaccctgcgccaccgcatccagatcggcgtcatcaaaaacaatcaccggggctttaccaccgagttccatatgcgtacgttttatcgctggcgcagtatggcgcagaatatgctccccggtcgcgatagaaccggttaaagagaccatgcgtactttttcatggccggtcaatacatcaccaacagtttgccctcgtccgaacaggacattgagcacccccggcggaaagatatccttcgccagcgcggcaagtttaagcgccgtcagcggcgtgatttcagaaggcttaatcaccacgcagttacctgccgccagcgctggcgccagcttccaggccgccatcatgagcggataattccacggcgcgatagaggcaaccacgccaatcggatcccggcggatcatcgacgtatgtccttccagatattcgcccgccgccagcccactcaaacaacgggccgcgccggcaaaaaagcgaaagacatccacgattgccggaatttcatcattaattacgcagtgcaaaggcttaccgcagttttgcgattcaagccgggcgaactcaagggcgttttgctcgatgctgtccgccagttttaacagacattccgcccgtgctttgggtgtggtctgcccccattcggcaaacgcgctatcggcggccagcactgcggcgtcaacctgcacgggcgacgcttccgcaatctcaagtatgacctcgcctgtcgccgggttataaacggactgcctttctccctcgccgtccaccagcacgccattaatcagtaattgatattgcatagcattttcccatatcgtcattaatcgatttccggcgaacgggccgccgctttcctaaaaatagacggcgcgccagatgctcacccggcacactcgggaaatttagtcaggttgtgagctgacacgcattccacctcacacaaggcttttagcgctcagcatctcgcgaatcaggcttccaagctgttttacggcctgttcttcccgttctccccaatgccatgcggtgttaaaacgaaagaaacgcgtccaggcgccggacgttgaaaacattttccctggcgcgatactgataaggtgttcaagcgctttggcgctaagttcgccggcatcaagctgctcaggtagctccagccaaagaaaataaccgctatcgttatggtgaatttttacttccgccgggagatggcgcaaaagggtttgccaggcttgctgtttacgttcggcaagctgccttcgcaatcggcgcagatgcgcgtcatatcgacgtgtcgagagataatctactaacgccaattgcatgggagaactggtggataatgtgctcattaactgcaaacgctgaatttgtctggcatggcttcctcccgcaacccagccaatgcgaaaaccgggaaccagacatttggaaaaagacgaacaatgcaacacggtatcgtcgcgatcccatgctttggcaggaagaggtttctcgcggccaaagtagagttcgctataaacatcgtcttcaattagcgtcacgttatggtgcgtgagtaacgcaaccagccgcgcttttttctcagcactcagcgtgaaccctaacggattctggctgttggtcattaaccagcacgctttcaccggatattcctgtaacgcctgttccagcgccataagatcgataccttctttaacatcggtaggtatcgacaacgctttcaggcgcaatcgctccagggcctgtagcgcaccgtagaaacaggggttctccaccaccacccagtctcccggtgccgtcaccgcctgtaaactaagattcaacgcttccagcgcgccggcggtaatgacaatctcgtcaggagaaacggtaatcccctgctgcgcgtaacggcgtgctatcgcatagcgcaattctgcattacctggcggcaagttttcgatgacgctcattgccgtctcggttttactgacctgcgccagagagcggttcaattgcggcaagggaaacagacgcggatcgggaaacgctgaggcaaagggcaccacagaggtatcacggctcgcctgcagcatctcaaaaatataggtattgatatctacggcttcatcccgaataacgtgcgctgccgtcgcgactgaccgacaaaccggatgcggcgcgacataataaccagattgcggacgggcgataatccgtccctgactttccagcaactggtacgcatgaccgacagtcataaaactcatgccgctactggcgacctgctccctcagcgagggtaatcgatcgccgggttgccaaacgccagaggcgatttgttctctaatttgctccgccagacgttgatattttttcattattcgttctcattgagcgctgcttgcaggtggcaaccgcagtgtatatcagttgttaaaattaacaatgatttgctaactgttatggtgctttccaacaggcgtaatgattagatttcgcaacaaaacgccgtttcagggtctctgcttaacgggaaagtcaaaccaggtgttcgggtatggttcatgagtaagggagaagtgccaccattcagtatccagtggcgtaaaacccgcatcacgcatcaatgtttgtaataacaacctatttgcgcgttgctgagcggtaagcatgacattatcgggatgggataacggactaaaacagtcaaagcctgtaccaaaatccagactattatctggcgagcgttgcgccgcggacgcagtacaattcaccagtggtcgtccgggatggtatatcggtattttactgtcaagtggaacaatcgttagatcaagcgtacttccccgactgtggccggatctggcggcaagataaccttcctcaaacaaacgatttttctctacctgcggataaaattcgtttttcatttggttttgagaaggatctttggcccacgcgataaagtcattcactgcgctttgcggacggtagcaatcatatatttttaaggtaagtccgaaggggcgtaaacgatcggcgacctgctttactgcgttcgcggctggtcgtgttaacaggcaaacaggcgcgttatagcctttaatggggcgaccaataaagttatgggaagtgaagtatcgcatgtctacctgtacgtcgggggcgaccgtagtaatatcgacaaagtcttttggctggtggagatcaatatggttttcagctgatattgcctgaacggacaacaggctgaacaggaggaaagaagatacgcattttaccatatgttacacctcgcgagagtcacaggggtgattatgtatttgagcaggtaaagattagcggacagcgcttaaacagatggttaaaataaacatcattccccccctgtaatctgtgccttattacaaacggagaggttatattttgcttattatggccattacgccgcctgttctatacccaaaataattcgagttgcttaaaggcggcaagggagtgagtccccaggagcacagataacgatatgttttcacaaaggcgagtctacctgaccagaaaggatatttgataatcaatagtacagttgttgtcgccttccataactaaataacattgtttcgccaaagataagaccactatatagtcaggaaggcaattagtgaggaacacgtcgattgtcggcgataatgcactgaaattacgattcactgcagttgtgcaaacacatagaatccccctcgaaccgagataattcggtctgctggtcatagccattattcagtaagaccgcaggttgcagcggcggatcacgggcgtgaagaaaaatcctgtgccccaaattttttggacaagcgctgaacctgccgtatacttttacttaacgtacactccgccataaaaataaaccctgcgatgataccgtaatgccacaggcataacttaaggatatgccataaatcaagcgaagcatgatttaacttctcagtaattgcgatagtctgtacaaatattatgggatgaaataataagacgcctaacaaaaatatccctgccacgatcatggcaagtaactggaaaaaagcccatccgataacgaaacggtaaagtaacagcaataatagccgtccacattttcttagccattctgactgcaaaatgccccaggatgctgtcttttcgtgaatttcaccatctgatttcttcattttgagcctcctcgcaggtttttataattttatcacctaactggaaataaacccgtcagctaatcgttacaacaaatataattaagacaaaaactaaagagtaaaggcatttatatcataagtactatcagcataggcctcctgccctgccgctaaatatctcattgttgttagcctaataatactttcagtttaacttcttataagacaatttgtacacggttgagcaacaatttactttctctaaaaataatatagcgtgtaattaaacattactcatggtatatgatgatgtgagaattaagaaaaccattttactttcattcgttttacctgacatacttcatggccaggaggcgtggactgactaaagccacgggtcgattttaacaataatgttgacggttcaggacaaagcaaaaatcaggtgtttcaccgataggcaaaccgatgggcaacatgggataatatttcgaataccacctattccagtaatgaagtatcatataatcacttgtggtctacattatgccaattactatcgggagaggatttttaaagagtgagatgttttctcaaagtgctatctctcaacgctccttctttacgtcactatgggaaaagattaaagattttttttgtgacacgcaaagatccactgccgatcaatatataaaggaattatgtgatgttgcctctccgcctgacgcgcaacgtttatttgatttattttgcgcgttatatgaattatcatcaccatcatgcagaggaaatttccattttcagcactataaagatgctgagtgtcagtatacaaatctctgtattaaagatggcgaagatattccgttatgtattatgatacgtcaggatcactactattatgagataatgaatagaacagtgctctgtgttgatactcagtctgcccacctgaaaagatattctgatattaatataaaagctagcacttatgtttgtgaaccgctatgttgcttgttccctgagcggttacaactctcgctatccggcggtataacattttccgttgacctaaaaaatatagaagagacgcttatcgccatggcagaaaaggggaatttatgtgactggaaggaacaggaaagaaaagccgccatctcctccaggattaatctgggcatcgcacaagcaggtgtaacagctattgacgatgctatcaaaaacaaaatagccgcaaaggttattgagaatactaacttaaagaatgcagcgtttgaaccaaattatgcacaaagctcagttactcaaattatttattcatgtttgtttaagaatgagatactaatgaatatgctggaagaaagttcctctcatggcctgctatgtttaaacgagcttactgaatatgtagcgctacaaattcataacagccttttttctgaagatttatcttcactcgttgaaacaacaaaaaatgaggctcattaccagagttgaccacaccataaatagtatggatttacaatcccctggcaataccaaaaccatctaatacaatacctttaaaaatatgcttccagggaataatggatttactatggaacgaattggctcgttatttttataattgacatactgagtataaatatattttctcatacaacttatcgcacttattgacaaaccgttttcgctaatttgaagtgttgaataataactcaaagaaattattggcatcatagcctcacgacgtaactggaaggtggcatgatgcttacaaaaacgttatcagtagttttactgacctgtgcgctattttcaggccagttactggcgaaacagcaagaccacgcattcgtatggtttgcgacgggagggcaccagcttagacacgaagccgacagcgatgaattacgggcggcagcggaagaatccgcggaaggcttgcgcgagcaccacaactggcagaaatcgcgcaaaccagagagctattttcgttaattaaacgcccctgcgcttcagcagcgttttcatcagcgcttcagggctcactgaagcgacaacgctgccgggctggggcatttttaagatgtggtttttaattttgccaatgacatgcatttcgcaagggcggcagtcgaattttagcgtcagtacctcatcaccatgcaccaactgcatcggcgtggctttccagctcttaatatttcctttcgcctgctttggacaaaggttgaacgcaaaacgcaggcagtgtttggtgatcatgaccggtacctcgcccttctcctgatgcgcctcataggccgcatcaatcaattgtacgccgtaacggtgataaaattcccgcgctttgtggttgtagacattagcgagaaagctgagatgcgtttgcggatagacgggcgcaggctgcgccacgggtttccgacgacctcgttgataatgggccagccgcgccgcgtcaagcatatcaatcgcctcccgacggaactgattgagcaggctatttggcacgaacaacgccgccggtaatgtcacctgcatatcacgcgcgtagtaaagcgtttgtcccagcttcgccagtccggctgttaggttattcaacgctttttcagagttgttggcttcctcaaataccccgtcaagcgtatgcgtgatgcagacaccgtcttcactggtcagtgtcagaataagctgttcctgccagccgcccagcatgatatcaaccgccacacggcgctcactggaggtttttgtcagcgcttgctgccagttatggtccagattacgattcaacggatgatgcggacggactttatgcaggtcggcaggcatatcatttggccaaacgcggtagcggttatgaccggttttctccaccgtattggcgcgaaaacccaccacttcacgcttaatcaacacgttcagaccatcgccattcgccaacggctccgtcgcttctacgtcgagataatccttcgccacattcagcacctcgcctaccggcaagccaataaattttggtgaatcaaatgcgccaatatcgcctttacgcgcgttaacaaaatagtcggtgctgccgcgatggaaggttttctccgtggagggaacaaaaaagtgctcggtccgaccaaccgatgcacgcgccagatcgccacgttgctcgataatcgcgtccagcatctgacgataatgcgcggtgatgtttttgacatagctcatgtctttgtagcgcccttcaatcttgaaggaacgtacgcctgcatcgatcaacgcgccaaggttagccgtttgatcgttatctttcatcgatagcaaatgtttttcgtaagagaccacccgcccctgatcgtcttttaacgtatacggtaagcgacaggcctgcgaacagtcgccccgattggcgctgcgcccggtttgcgcatgagagatataacactgtccagaataagcgacacacagcgcgccatgaatgaagaactcaatcgtggcgtcagtagcctgatgaatagccgctatctgactcaaattaagctcgcgcgccagtacaatctgtgaaaaaccgacatcggcaagaaacttcgctttttccacgctgcgaatatcacactgtgtactggcgtgaagctcaatcggcgggatatccagttccagaatgcccatatcctgcacaatcagcgcatccaccccggtattgtacaaatcggtgattaaccgctgcgcgggctccagctcatcatcatgcaggatagtattcagcgtgacaaaaatcctggcgccgtaacggtgagcaaacgggaccagatcggcgatatcgcgcagactgttactggcgttatgacgtgcgccaaaaccgggtccgccgatgtagacggcatctgcgccatgcaaaatcgcttcgcgagcaattgcggcgtcacgggccgggcttaacaattcgagatagtgaggttgctggcgcatacagtctttcttatccaatagcagcgaaatggcggctattgtagtcagaagcgcaaactaacgaaatagttttcccgcttaatcacgtgggtaatggatcagcgagtgaaaatgaaccgtctggtcactactgttgcgataggtatgcgccgtatcgccggcaaaacgcaaacctttaccggcgtctatggtttgccataccccaccagtacacatgtccagccgaccctgaatcaccaccacatgttcgataacgccggctttatgcggcgttgattcgctgaccgcgccaggcgccagcaatagggaaaaatagtcaaaacagagttcagggtcccacggaaacagcggtgtgattaccatcgcttgctgctggggatcgaaggttggaggaaattcggcctgcggcggcgaaataaacattgagaatggaacgttcaggcccgtcgcaattttccacagcgttgcgactgtcggactggattcattacgctctatctgccccaacatggcttttgagacgccggagatctccgccagacgtgataaactccagcctcgctgatggcgtaacgttcttaacgtggtcgccagatagtgtgtcaggttatccatttttcccccctgtaaggccatagcgtatcacttgtacgctataacgcacaatgctacattgactgaccgttataacgcacaagaggcgatcatgcgtctgttatcactgccgttacctactgtattatctggtctggtcgccgttctggtcggctatgcaagttccgccgccattatctggcaggcggcgcttgccgctggcgcaacacccgcagagatcgccggctggatgaccgccctcggtatagccatgggcataagcacactaacgttaaccttgtggtatcgtgcgccggttttaaccgcctggtcaacgcctggcgccgctctgttggtgacagggcttcagggattatcgttgccagacgccgtgggcatattcattgtcgccaatgccctgattgtgctgtgcggcgtcacgggattgtttgcgcgtttgatgcggataatcccccattctcttgccgccgcaatgctggcgggaatactgctacgcttcggcctgcaggcgttcgggacgctcaacggagagtttgtcatgtgcggcggtatgctattggcgtggctactctttaaagtattcgcgccccgctatgccgttattgctgccatggtgatgggaataacggtggcgctcatccagggtaagatggcgatgagcggtattcatttcgcgccggtgtggcccaccttcgttcccccccacttttcattcgctcaaagcctgagcgtcgcggtaccgctcttcctggtgacgatggcatcgcaaaacgcccccggcgtcgccacaatgaaggcgtctggctatcagcttcctgtctctccgttaatgatttttaccggattactggcgctgctgctttcgccgtttggcgtttattctatctgcattgccgccattacagccgccatttgtcaaagcccggacgcgcaccccgatccaacgcgtcgctggttagcggccgccgccgcaggcgttttttatttacttgccgggtggtttggcggttcgataaccgagctgatggtcgccctaccggttagctgggtgcaaatgctggctggtctggcactgttaagtacgattagcggtagtctgtatcaggcgcttactcacgaaagtgagcgtgacgcggcagttatcgcatttctcgtcaccgccagcgggctaacgctgatgggcatcggatcggcattctgggggttgatcgctggcgggataggctacgcaatattaacgagaacgcgccgcccgtcgttgtctggctgatggcggccgctaatctgccggggtttgcgccatcttgcgatggcgccgcagaattattttttgttagtgtcaaacatagaggtatccgtcgccatatcatccacaacctgtttcaacgtctcaaacgccattggcgtactggaattactcaggtctttaccttcgccctggcgcactaccttgacgaccggcttgttggtcgcggcatctatcagctcaccctcaaaatagaggtgggtatccatggtccggtggcccgtcgccatttgcgtgcccgccacaatcagcgctacagggatcacctcatagaattgcagcccttctttgctggtatccacgcccgtaatcgcctcgcggaaaatcaaactgcgcggccctgccgtcgtgaccagcggtttgcgctgttcaattgctgattttactttagtgttcgtataagccagcagtttatcaagaacttgctgtccgacctgggtcgttggcttggggatggggtaatatgttatcggattgtaaacaatactgtcatagttagagtcattaaaatgtggatctacccagcgcaacaccggtttccccgtggcggaagtagtctccttcaggtccgaataattttttaagaatccagaatacttatccggctgtgtgactttagacgcacagccggataacgccagcaagccagtaagcactgcaactttaaataaagtatgagtacgcatgaaacgatccctttagtcttcgcaatgatgcaaaggaaataatagcaaaacgaaatcattctggatgcactaaaaatggtaacgacagcacaatttgaacgcggcgcccgacaaaaaaatgccgaacgcagcaagacttacagaacttgcatcgctcaggccgtttttctcgccagcatcgtagcaaagcgcagtttgatacggttgccgttttcgtccgtgcggtgaagctcgccgacatcttcgttgtatttcagcatgtcccatccttcgtaatagcggcgtaattcgccttctttaaaagcgaacgggaatcccaccgtacagggaaagcccggcgtatccattgccgcaacaatcaaattatacccgccgggttttgtgcagcgttgcatattggcaattaaaccgggaatggtttgcgcctcaagaaacatcataaccactgtcgagagaataaaatcgtattcgccgtcaaaggtcaatgtattcagatcgacaaggtcggtttgcagattatccagcccttctgccgctttaatacgctcaaggttagccatactggccggatttttatcccacgcggtaacgtcataaccgttcgcggccagatacagactattacggccattgccacatcccaaatccagcgttcggcctggcgcgacaacctttgccgccgccagcacatccgaatgcgtgcgggttaaaccgtatttctcagtaaagtaattttcgtcacgaacggtcatttttttcctccgttttcaacagtgcagcgcgctcagtgcgaataagcaacgtcccctgcaccagcaatagaaatgtacgaaccagcaataaggcgataatagcgttagtgaaaataaacagcgggacggccagaatatggaaaaaccctgattcactaccgtgaccaagatgtaaccccgtggtcgtcagcgcggaaacgccgaacgaaaaactccagaaggaagcattaaacggttgtgataaataccagggcattaatcgcagcataaataaaagctgtaacagaccgtagccgaatagcattttcgccagcgtgtcgccctccccgccattgacgctcagccaggcgctacaggcgaccagcgcgggcgccagttggatacccagcgacatacgcagcaccgccggtaattcgccgcagctacgcagtcgctgcaaaataaccggttccagacttaaccacgaaaagacgcctgcgcctaaaaacaccagtccggcatcattgtaaccgagcgctccacaggccatagcgctgataaaattattcgctaccgtgggcagataaagtcctggggttgtcgcttcttccggatgcgctccgcgccaaagacccgccgtctgccaggcggcatacgccagttgtatgacgacccccacgctgaatagcgcaacggccaacgggcgataccagggaacgaaaccgatcgcgaccagcatcgtggtggcgggaaacaggctgacaaaactgctcattaccggatgtcgcacttcagccatcacgctatggggaaagcgcaccagacggctaaggaacgccagggtcaagagtgcccaaataatcatcgccaggatcaccatgatgtcgccgggccagtggcttattgcccatatctggctggcataacgccaggcgaatcccataccgatagtgccaaggacgatgccaaaatagcccgcaggcagattgagcacgcgatcgctctgcttgtgattacacattttgtttaatttataaagtatatttgaaatgcattttatggaatttctggttgtttcgccagtacctttgctacggttatcttaatcgttcacacggaatttccctatgatcaaatatcgactgagtgaagaacctcgtgcttttacttatcaggtagacggtgagaagaaaagcgtcttattacgacaagttattgccgtaacggattttaacgatgttaaagccggaacctccggcggctgggttgatgccgataatgtgctgtcacaacagggggattgctggatttatgatgaaaacgcgatggcctttgcgggcacggaaattacgggtaacgcgcgtatcacgcagccgtgcacgctctacaataacgtgcgaataggcgataacgtctggattgatcgcgctgatatcagcgatggcgcacggataagtgacaacgtcaccattcagtcctcttccgtgcgtggagagtgtgcgatttatggcgatgcccgcgtgttaaaccagtcagaaattctcgctgttcagggactaacgcatgaacatgcgcagattttacaaatttacgatcgcgccaccgtgaaccattcgcggattgtccatcaggtacagctttatggcgacgccactatcactcacgcttttattgagcaccgggcggaggtctttgatttcgcgctcatcgaaggcaacaaagacaataatgtctggatctgtgactgcgccaaagtctatggccatgcgcgggttatcgccggcacagaggaagatgctatccctacccttcgctacagctcgcaggtagcggaacatgcgttaatcgaaggcaactgtgtgttaaaacatcatgtgctggtaggcggacatgctgaggtacgcggaggtccgattttactggacgaccgcgtgctgattgaaggccatgcctgtatacagggcgaaattctgattgagcgccaggtcgagattagcggacgggcggcggtgatagcgtttgacggcaatgctattcacctacgcggcccaaaagtgatcaatggagaagatcgtattacgcgtacccccttagtcggttctctttaatccgcatcaataatgcgggcatacatattaacgtcgtgatagtcgccgttaagatactccgcctgtttcatacagccttccagcgtaaaatggttgcgccgtgcgaccgcgttactggcctgattatcaacgcggcatttaatgacgaagcgccgaatatcgccgcgccgggcataatgtgtcatcagcgcctgtaatgattgcgacattatcccttgcccctgaagggactcatccagccagtaaccgatataggcggctttgtttatcggctcgatggcattaaatgagagtacgcccgccatctcatcctggcagaaaatcaggtacattttggcgtaaccacgctggtgcaacagcatattaccctgcacatgcttacgcgtttcctcctgcgacgtgacatattgcggccagtcgagcgactgttgtagccacgctttgtttttgagtaccagttggtgcagcgccggaacatgactttcatctgccgctcgcagttccagcgtcgtgctaacaggaataatttccaccatcgcgttgcccttcttcgttgttggtcgtgatcacataaatagcctggtttaccgataacccgcaggtgatatgagcgtttttattgtatcgccatcacattattttttattgaccatatttagcgtatttccgcgtgacacatttcacacttatccaaccattctccgcctataaaacgctcaacgactgattgttttatcaccacggagacgccaatgaccttttctgtgcaggaaacgcttttttctttactgcggctaaacgggatttcaggacatgaaagcagtattgcaaacgttatgcagcacgcgttcgaacagcaggccaaagacgtctggcgggatcgcttaggtaatgtcgtcgcccgttatggcagcgataaatccgacgcgcttcgcctgatgatttttgcgcatatggatgaagtgggttttatggtacgcaagatcgaaccctccggttttttacgttttgaacgcgtgggcggcccggcgcaaattactatgcccggttcgattgtgacgcttgccggatgttcaggcgatatcatgggctgtatcggtattaaagcatatcacttcgcgaagggtgacgagcgcacccagccacccgcgctcgataaactctggattgatatcggcgcaaaagataaagcggatgccgaacgaatgggtattcaggtggggacgccagtaaccctttacaacccgccgcactgtctgggcaacgacctggtgtgcagtaaggcgctggatgacaggctggggtgtacggcgctactgggcgtcgccgaggccctcgcctccacaccgcttgatatcgcggtattcctggtcgcgtcggtacaggaagagttcaatattcgcgggattgttcccgttttacgacgcgtgcgccccgacctggcgattggtattgatatcaccccctcctgcgacacgcctgacctgcaggattactcggatgtgcgggtcaaccacggcgtcggcatcacctgtctgaactatcacggacgcggtacgttggcgggactgattacgccgccgcgtttgctgcggatgctggagaccaccgcgcacgaaaataatattcccgtacagcgtgaagtcgcgccaggcgtcatcaccgaaacaggctacattcaggttgaactggacggtattccctgcgccagtctttctattccctgccgctatacccactcgccagccgaagtcgccagcctgcgcgacctggctgattgtatccgtttactgactgcgctggccaatatgtcgccagaacagtttcccattgaccctgaaacaggcgctacacaagaggcacgaccatgatgaaaaagatccttgtggcatgtggtaccggcatgtcgacatcaaccatgattgcacaaaaactgcaggactttcttgcggagcaaggcattgcggcaaccacggcgcaatgttgtctgaatgagatcccgttgaactgtaacggtatggatctcatcgtaacgtccatgcgtacgcacagtgactatggcatcccgacgctcaacggcgccgccctgctgacaggcatcaacgacgacgcattaaaacaagaaatcaaggcgctgttaacacaataaagggggcattatgtttgattacatcctgtctctcggcggcaccgtctttgtgcccatcattatgattatcatcggcttaatctttcgtattccctggctgcaggcggtgaaagcgggggtgacggtcggcatcggttttgtcggcatggggctggtgatcgtcatggcgatcgacagtctcagtccgccgattaaagtgatgattgagcgttttggcctgacgctgcatgtgtttgacgtcggcgccgggcccgcatccggcgtcggctatgcgacggccatcggcgcgatgatcattcccgttatctttctgctcaacgtcggtatgctggtgactcgtctgaccaaaaccatgaacgttgatatttataactactggcactacgccattaccggaacggtcgtccagttgatgaccggcagtctgatttatggcgtactgggcgcgatttgccatgccgccttgtcgttgaaaatggccgactggacgacgaaacgggtacagaacattgtgggtctggaagggatttctattccgcaagggtatggctccagctccgtgccgttgttcgtattgctggatgcgatatacgaaaaaataccgtttatgaaaggacgcaatattgacgctcaggagatccaaaaacggtatgggatggtcggcgacccggtgatcattggcgttgttctcgggctgatcttcggacttgctgcaggcgaaggctttaaagggtgcgcaaccttaatgattaccgtggcggcgattatggtgctgtttccgcgcatgattcgccttatcgttgagggattaatgcccatttccgacggcgcgcgtaagttcttccagaaacactttaaagggcgcgaagtctttatcggtctggataccgcagtgacgttaggccacccgaccaccatcgcggttggactgctgttaattcccatcatgttaattctggcgagcatactgccgggcaataaagtcctgccgctggctgatttaccggtcgcgccattttttatctgcatggccacagttattcatcgcggcgatctgattcgtactctgctcagcggcatcattgtcatgattaccgttttgctgatcgccacccagttcgcgccgtactttaccgatatggcgctcaaaggcggctttagcttcgccgctgaaaacgcgcaaattaccgcgctgtcggtgggaaatatgtttggctggtcaatatctgaattgatgtcgctgggcatgattggtgtggttattgtggtcggcattgtcgccagcatcatacttgtcttacgtaaacgtgaactaccggaataaggagcaacccagaatgagttggctaaaagaggtaataggaacagaaaaagccgttatcgccatgtgccatttacgggcgctgccgggcgatcccgggttcgataccaggaaaggcatgaactgggtaattgaccgcgcccatgacgatttaatggcgctacaaaatggcggcgtggatgcggtgatgttctccaacgaatttagtctgccttatttaacgaaagtcagaccggaaacgactgccgcgatggcacgaatcatcggtcagttaatgagtgaaattcgcgtaccgtttggggtaaacgtgttgtgggaccctgtggcctcttttgatttggcgatggcgaccgacgcaaaatttattcgcgaaattttcaccggtgcttacgccagcgattttggcgtctgggatacgaatgtcggcgaaactattcgccatcagcatcgcatcggcgcaggccacgtgaaaacgctgtttaacatcgtgccggaagcggcggtgtatctgggaaaccgagatgtctgttcaattgcgaaatcgaccgtatttaacaataaccccgatgccctgtgcgtctcggggctgacggcgggcgcccgcacggatagcgccatactgaagcgggtaaaagataccgttcccgacacggtcgtgctggcgaataccggggtgtgtctggaaaacgtcgaggagcagctctgcattgccgacggatgcgtaacggcaaccacgtttaaaaaagacggcgtcttcgccaactttgtcgaccaggcgcgcgtggcgaagtttatggagaaagtacgccatatccgacaataaaatggggataagcaaaacgcttatcccctgcagagagcgataactcttctgccgatctccgtcgccttcgccaaaagacacgccggggatcggtttcagagtaacccgaaccggcaaggagtcaacgatcgatgattaatgatgttaagtgggttcaggcgcaacgccatgccagcgactggcgacacgcgctggatatcgccgttcgtccgctgattaccttcggcgcggcggccccctgctacctggacggtattattgagaacacccttaaatgggggccatattatcttatcgcgccggggattgcgctgccccatgccagaccagagcaaggcgccaaccataatcaaatcagcgtcactacgctatcaacgccggtcgctttcggcaatgcggattgcgatcccatctggctgttgctttgcgccagcgccacggatgccgaagcacatattcgcaccattcaacgcatcagccagtggctcgactcgccggaaagcgtcgcgatgttgcaagatgcgccaaatgatgccgcgcttttcgcgcaattaaccgcattgcgctgatgaaggttccgatgatcctgcacccttcactggcctccgccgatccgctgcgctatgccgaggcgttgaccgctttacacgatgcgcctctcggctcgctgcatctggatatcgaagataccagtttcatcaacaatattaccttcggtatgaaaaccattcaggcggtcgcgcaatactctcgccatccgctctcatttcacctgatggtttcatcaccgcaacgctggttaccctggcttgcagctatccgccccggctggattttcattcatgccgaaagcgtgcaaaacccctcggagattctggcggatattcgcgctatcggggcgaaagcaggactggcgcttaacccggcaacaccgctattgccttatcgttatctggcattgcaactggatgcgctgatgatcatgaccagcgaacccgacgggcgcgggcaacaatttattgccgcgatgtgtgaaaaagtgagccagagcagagagcatttccctgctgcggaatgctgggcggacggcggtattacacttcgcgccgcacggctgcttgccgccgcaggcgcccagcatctggtgattggccgggcgttgttcacgacggcgaactatgatgtgacattgtcacaattcaccgcgctataaaggagtcatatgctgatgagccaacagcgccccgaccgtatcaaacagatgttgcattacctttggcaacacaggcacctctcaacacaacaagctattgagctttttggctatgcagaggcaaccgtgcgccgggattttcactatatcgccagccgttatcccggtatggttcgcggccatggttgtattgactttgacgacagtacggaagataaagaatatgttttcgacgttaagcggacgttacaaagcgaggcgaaacgcgaaattgccgccctcgcccgcacgttcatcaaggatggagactgcttttttctcgactctggctccacctgtctggaactggcaaaatgtctggtcgacgccaaagtaaaagtcatttgcaatgacatcaaaatcgctaacgaactgggtggcttcccacacgtagagagctacattattggcggactgattcgccccggctacttttcggtgggcgagagtctggcgctggagatgattaacgcctttgccgttgaacgcgcctttatctcttgcgatgcgctgtcgattgaaacgggcatcaccaacgctaccatgtttgaagtaggcgtcaaaacgcgcattattcagcgctcacgcgaggtcatattgatggccgatcattcaaagtttgatactgtagaaccccatgcggtggcgacgctgtcctgtattactaccattcttagcgacagtgcgctcccgtctgctatcgcccgacgttatcagcaggcgggatgccgtctcatcatgtcagacccctcatcaggagcgcgttaatggacatcaggcaaatgaacaaaacccatctggagcactggcgcggattgcgaaaacagctctggcctggtcacccggatgacgcccatctggcggacggcgaagaaattctgcaagccgaacatctggcatcatttattgcgatggcagacggggtggcgattggctttgcggatgcctcaatccgccacgattatgtcaatggctgtgacagttcgcccgtggttttccttgaaggtatttttgttctcccctcgttccgtcaacgcggcttagcgaaacaattgatagcagcagtgcaacgatggggaacgaataaagggtgtcgggaaatggcttccgatacctcgccggaaaatacaatttcacagaaagttcacctggcgttaggatttgaggaaacagagcgcgtcattttctaccgaaagcgttgtcgaggaaaatcacacaggaaaaggtcgggtataatacccgacctctatattactgtattactgtggcagatctttttcagttaacaagcgtgtcgttttcacttgttcaatattcctggcgccacccaacatcatgttaattgtcagctctttgtttagctgttcaatcactgatgccacaccctgagcgccgccaagattaagaccgtataatacaggtcggccaaccgccacaatatccgccccgctggctaacgccttgaatacgtgcgaaccacggcgtactccactgtcaaaaataacaggcactcgcttgttgacgacttttgcaatcgcaggaagcatatcgaatgaggacggcccgctgtctaattgacggccaccatgattagaaacccatattcctgcggccccagcctggatagcaatttcagcatcctccggcgactgaatgccttttacaataaccggcagaccggaaatacgatgtacataggcaatatcctccggcgtaaaggcttgtttagcctgcgcgtaaatttcacttatccctgcccctttgccggtttttgaaccatcgtcatttttcctggcgaacatttccaggtttgcaaaactcagcgggaactggaagttatttttaatatcttcttcccgataaccgccgacaggtgaatctacggtcagaataatcgctttagcgccatgttttaccgcttgtgcaagaataaattcgttaaattgattattcttactcatataaagctggaagaagaacgggtttttcccggaaacgttagccacctcttcgatggtcttgttgccataagtgctcaacgagaaaatcgaaccgacctgcgccatgcctttcgccgtcgccaactctccggaggcgtgggccaggccctgcgccgccatcggtgcctggattataggcgttttaagcggaatacccagtagctgcgttgataaatcgatctcttttaactcaatgccctgtaatacgcgcggcataatatattttttgtcaaagctttcggtgttgctgcgaaggttattctcatcttcggctccaccgcgaatataaccaaatgcccctttctccattctggcctgaacgcgcgcttccagagaggctacgttcgtcatttttattgctttttcgtccgtgctggctttgtactcttcagcataagccaggcctgatgttgccaacattgccagcgaggccactacccgaatgaggtgatgagttttcatcattattccttttattgcttaaccgcttctgcctggatttttatatcgacaactttcgtcatccccatatcgaccagataatctacaccccactgggtgcgatctatttgcgtgacaaaatcaccaccgcaaacctgcgccttgaatatcgggctcatataacagccaaacttggtggtggttaaggtgacgggcttagttactcccttcattgttaacaaaccgtcaatagaaactggtttattatcttcaaaatgccattttgtcgatttaaatactatttctggatatttttccgcatccaaaatatcgctactgcgaatatggttatcaaacgcatccaccccggtatttaaggcgctcacgggaatcgtcacacgcatctctgcgacttgcttttccggctgatatttcagttcgccgctaatagcataaaacccgccatgattggttgaggtctggaaacgatcgatattaaataccgcattggtatgcgtattatcaaatttatatacatctgcatgagcagcacttaataaacccagagacaggagagcaccaagaaaactctttttcattatattcactttatatcttaaataaggtgaagctatcttaatgtcccctgtccgcaggatcgagagggataaacaggaaggactgttgcaaaaatagaacgatgaaaaggccgtgtcacaaaaacagcggctcacgaatgggtttatgtcatggcaatttccgcaacctgtaccgcctttgtggcggtacagaaggcaaactgactaacgcatgatacgatcgtcgacataacggcgcttatccggcgcgggcgggaaatactgatacagccaggtttcgctgatagcctccccctggcagcgcaggaacatacgcatatccaccggtgccgtagaatccgaggtcggataccagtcaaactggatacgataaccgtcgaaaggctctacgtagaggatctcaacctgcttcgcctcaccgctggagagcgtaattaccggctcaatgccttttggcgcggccgctttcagatcgccgccgacaaaatcaatagcaaaacggcgtgcccatttatccgggtaatgttcgcccggcgcccagccttcgggaaagccgcccatccctgtacgggtcgccatgacccgcgcaagcggcgattgtaccggcggctgcgcgctccagtacaaacgataattaaacgccagcgtatccccggctttgatcgctttttccggctgccagaaacagaccacattatccagagtttcgccagtggttgggatctccatcaggctaaccgcgcctttcccccacttactgcgcggctccacccacaggctcggacgtttgttgtaccagcccatgacatcctgataatgcgagaaatcgcgatcgagttgcagcaggccgaacccttttgggttatcgtccatatatgcgttgaactgtaatttctgaggattattcagcgggcggcaaatccactcgccgttaccccgccacatcgccagccgatcggaatcgtgaatttgcggatgaatggtgtcgcatacccggcgttcattattcccacagctaaacatactggtcatcggcgcaatgccaagttgctttatatctttacgggcgtagagatggttttctacatccatgatcacctgcgttttttcgcaatggatcacaaacttatacgcgcccgtcacgctggcgctgtccagcagagcgtaaacggtaaacgtagtatcgcccggcttcgcggtgtcaaaccagaatgcggtgaagtcagggaactcttcctgaccgtcagtataggtatctatcgccagcccgcgagccgacaggccatactgataagtatcatctaccgcccggaaataactggcgcccaggaaggagacgacatcgcgccgcgccagttccggcgctttaaagacacggaaaccggcgaaaccgagatcgctctgcccttccagttgcgtcgtatcaacgccggcatcgttgtatttaaacagttccgggcgaaaatgaatctcgcgagcaagatgcgtcgtcgtatcaacggaaaacatgcgtacgcgacgacggaagcccatccctacgtggaaaaactgaatatcgagctgccggttggcaacaccgttccagagtgaatgcgccgcgtcatactgaatgctgttataggcctgcggcgtcagattggcgagcgtatccggcaagggtcccggcgcgccaccccagggctttttcgctaacgcctgggccattgattgcagaccagcaaaatcaaaacggacaattttaccatccgcaatatcggattccgcggcaaacgccgcctgagaaaagagtgaagcaataccgctggaaccgcacacggcggccattgccattgaacctttaataaatcgtctacgattcatacctgaaaatgagtccttctggtcttgtgaatggtcccgcgctggttttttcagcagcaagaatgtgcccgtttctgaccgctcactctagacaaaattcattaataatccaattgttggtcgcctggaaactgtgcaaaagcgtaaatattttatgtcgataagaaccgaccgaatcggatgtaaacctcacgcagcattcttcaggttatgaaaagtttattccagactaacgtgatgtttcatgactcgtttaaacagcgccagacgcgcacgcataaagcggttttccactttaaaaccggcaagtttgttcagcccaatccgcaacagacgatctcgcccccgaatgctggcgggccagcgaaccgggccgtgcagcacgtcgcgcgtgcggctggcatgacgagcgaaattcacccagtaatccgccacctgcgaggcaaaggccaggtcattctcattcacataatggcatgtgggctcagcccgcgttaacgtatcgaatacatacggtatttcattgccatgacaggcgctattcgcgtaggtgttatgctccgcctcggcgacataatcaaaccagtaacgccagcacggttcgccgatccgcttctgcgcttgcatgacgacataacccaacgtggtaaataccatatcccgacagacctgccgccctagcgcttcgtcgcctttcactccaggataaagcagccggattaaccccaagccaacacgccgctcacggcgcattttttgaatttgaccggcaatatcgacgccaaaaacggccaatacgctggcttcatcgctattcgagccgatcatcaccggtattggatgctgtttcgccgcaaagaaggtttccagcatcggatgcggcagcacgacgtcgccggaaatcggcgtcggcgcaattttaaaaggcgcgtccagcggccaaaacgtctctgccggtaaagcgcgtagctgttcggcagtggcatgggctaaaccaagatgttccgccagcgcaacgcctttttttagcgccacctcgcggggcgtatccggcagcgtataaccactctgaataatcgctttatgaaaaagccccttcgccaacggcgaagccatcaacgacagcacgctgcgggcgccggcggattcgccaaataacgtcacattctgcgtatcgccgccaaatgcggcaatattgtcctgcacccaacgcagcgcagcgatttgatcgagtaaagcgaaattatgaatacactccgccccttcgccttccagcgccggatgcgcgaaaaagcccagatggccaagccgataattgaccgtcaccacgatcgcgccgcgcttcgccagcgcttgaccgtcatagggcggcaaactccccgcgccaatggtgtaaccgccgccgtgtagccagaccatgaccggcaacggttcatgacgcacggcgggagcccagacgttcagatagagacagtcttcggaaaaatttcccggatcgccgccgccgagttcgcgacaccaggtaatatcctgccaactggcgcaggagaaacaatccgcctggcgcacatcctgccagggcgtaacaggctgcggcgcacgccagcgtagctcccctgttggcggcgcggcataaggtataccgcgccagatatggatttcttcctgtacgacgcccacgattttaccgtgacgcgtcgccaccagcgggatggagggattcaacataacgccttccttttacagtatcctcacagcctgtgaagcttaccgcttttaaagcagaccgcaacggcgtttactgcgttcttccgcttcctgatataacgaaaattcatcccgtacagcacatcccagcgcctgttcaaaggcgtcgcggctggcattgccgtggcttctggccagcgtttcatttcccaaattcgactgaaaaatgccggctgcgctgaccggaagaaaatcttcataggtaatcggctgcgcgatcacccaaccgcgctcaataagcggctgcggatcgtcgccaggatggatcgcctgacgatgcgcctcgccggaaggcgttaagcgataacggaaccaggcaagcccctgcaggcgaagcagaaattcgctatccggaaaggcgttaaagacctcccgcaaatggagttgatgcgtgaagttgtccttacccgttcccgccttgtgcaacagttcgtcatataatcgacgaccttttggcgtcagcgcgacgccacgttgctcaatttcgccgaagcgcgccgtgtgcgtaccctgcttttcatcaacgaagagcacctgctcttccagagctttgaaactggtttgccgcaacagaataggcacttcgcggcgaggcggaccttcgataagaattttaggcgtaatgccgcactccggcatcatggcctgtacccggtcgatatccagagtacgcggcgtcagatggttaatgtggcatcccggaaaacagaccacgtcggcaattaaacgatgctcacgatgcaggctgcggtacgtttcttcatcaacggtagcctgacgatgccagcgaaaagtctccagcgtttcacggacgaactcttcggcctgagcagcactaaaaccgccctgctcgtcgtactcatccagcaattgtcggcagcgcgatgtaaaaatatcacgctgcgataagatttccgccgcccgctggcgtaatgccgcgttttcaatgagctccaggcgtaatagcgaagtgaacatgcgaaagggattacgcgagagcgaagcctcgtcaatgggacgaaatgccgtggagtgcacaggcacgcccgcctgagagagatcgtaataacttactgggtacatccccatgatggcgaatatccgacgcaagttcccggggctaaagaccctcagctagatatatgtccgcaatacgtcttcaatgactttgtccatccaacccaggaagtccatcattgttttgccacaatgttagaaagttttatagctcatcattattccactgaataatgttccatcggctgcggtacgccttgagcaaaacaccgctcaatatcatagtgccggtgacatgaaaatatgaggttgtctttgctgccggttggtcaataagtgatccatactctatgttcagtaggacaaaaatggatagagtcgatagatcgccaccgtaactacaatactcactatcacactggcgataaagtatgttttgaatggctgcttttgcgttttatgacggaaaagttgttgaccaacaatcgcaccaggccacccaccgacaaccccaaacaccaacaaagtggattccggcactctgcgccaggttttacgtgccgccgttttatctacaccgtagatcgccagcgttagcacattggcgagcaggaaccacatcgcgacgggatacgatgtaaaaatgcttccgaccgcagcagagatcaggagtaaataacaaaagcggttaagatacatattattatgtcatagcaatgattagggacatcggagcccattatacgcgatacatgcgcctatgtgatgcagaattttcttttcattcagccaacgagtcatcgagtcatcgaggattcatttttaattaccatggtaatcataaggtaattaacgtgttgtgaacacgattaaaatgggtaaagccaccaaaaatgttaccaccttaaccattgccaggataacttaatggagagccctctttattgctgtttgttatccggttggcagtctcagttttggatttatttatcgtatttatgtttattacataagatgtacgatgttaatttgagaattttatcccgacaaccgcatatattaagatatttctgaattaagattattatcgattaaaacaagttaacgttttgataaacataacaacatcgtcagaactcctgatttgttgtcgtttgttcataggataaataatttatatgcttgcaaatatagatagcacgcaaatcaatttagctcagaaaatgtatttgacaagcaaagataagtctttatattggccctggatagagtggtaagatgatacttagagacattaaatacaccgtcactgaagcatttatctgcttatcatgtaaatatgtatgcgtaaatggagcataaactatgtccagtatactaatgtctatggtatctttacattttcacctttcattgggtcgctgcactcatatccagttgatatctcatggtatattcaatccattccctttgatgattcctgtcaaacctcctgattaaattagttaacagcgatggaatacataacgttaagtactttacgcctgcaaatgtcaggttcacgctctaatgcttaatttataatacgtattaccttaccacaggaaatagatagcatgttatccaaaaaaattggcttatcgatgatagtgttgggaataatgtcgtcttcagcttttgctgatagcatcgttgaagggagaacactcaatgtcgcagtatcaccggcctctccccctatgttatttaaaagtgctgatggcaaattgcaggggatagatctggagcttttttcgtcttactgtcagtcacggcattgtaagctaaacatcaccgaatatgcctgggatggaatgcttggcgcagtggcgagtggtcaggctgatgtagcattttcgggaatttcaatcacagataaacgtaagaaagttattgatttttctgaaccttattacatcaactctttttatctggtcagtatggccaatcataaaataacgctcaataacctcaatgaattaaatcaatattctattggataccctcgaggaatggcttactccgaccttatcaaaaacgatctggagcccaaaggatactactcgttaagtaaagtaaaattatatccaacctataacgagacgatgactgatctaaaaaatggtaatcttgatctggcttttatagaagagccggtttactttaccttcaaaaataagaaaaaaatgccgatagaaagtcgttatgttttcaagaatgttgatcagcttggcattgcctttaagaaaggctctcccgtgcgcgatgattttaacttatggcttaaagagcaagggccacaaaaaatatctggcatcgttgataactggatgaaatagtaagctatgtcatcaggtaatatgctggctatcttttatttcctattggaagggattggtaatacgctgcttgtaacctttacctgttttctctcagcgtttttgaccgggcttacagtcgccgtattacggcgactatccccccttccactacagaagatactcgacgtactggtctttattcttcggggaattccaatacttattgctgtttttcttgtttattttggattgccatcgattggcatatatgtttcacctctggtggccatgaacctcagcgtcggcttaatcagcgggagttatcttgccgaggtgttcagaggggcgcttaaattagttgagccattcgaaataacggtagcgaaagtagcaggaatgcgtcaattacaggttataataaatattgaactgccacagatgttgcgattttctgtgcccggtattatcaatgagttttcttctgtattaaaagcgacgccctttgcttatactgtaggcatcgctgaaataacgaagcaggcaatgtcactgacagccatcacgctgaacgggttacagatctatacccttgccggggtattatatttcattatttataaagcatttactcttctggccggagtgtttgagaaaaaatatcgcatcagttgaaacataaaaatagaggtgatactcatggctttactggaactaaaagagataagtaaggaatattcaggaaaaaaggttcttgatgcggttagtttgaaaattcaatcgggagacatgaaagtagtcatggggccatcgggttgtggaaaaacgacgcttttacgctgtctgcttcgattagaagaacctgattatggcgatatttattttcacggggaaaatatttacgacaaagaatttactattcttgagttcagaaaaaaagttggttgtgtcttccagaattacgcattgtatcgccatcttaacgtcatggataatattacccttgccctatgtaaagtgtttgggatgccgggacaactagcccgggagaaagccttacatgagctacaaaaacttgatatggtctcgcatagcgcgaaatacccttcgcaattatcgggtggccagcaacagcgcgtcgccctggcccgtacaatggtcaccgacccagaactcattatttttgatgagccgacgtctgcgcttgatccgctcatgactcgtgaagtcggaatgttgatcaagcaacttcacgacaatggcgtcactatattatgcgtcactcatgatattcgcctcgccagattactaagcgataacgtaacgtttcttaatcatggcaagattcgtgcagaaggcgcttttaccgatcttgccttacgagaaacggatccagatatccactgtttttttagcgaggcacaacgatgatcgctggctggtctcttttctttaatgacctgactgaacaactgccacttgttgtggacggtattaaagaaacctgtaaacttgcgctgattgtttccatcaccggttttttgtggggaattattattttctttctgagcctgagccatcgccccgtggtaaaagccataactcgactgtacatggatttctttatcggtacgccactcattcttattctgtttgttatctattatggtttacctcaatctggcattcacctgtcctcttttaccgtggcggttacaggttttaccttgaatgtcggcgcatataatgccgcgtacatgacaacggcctataacgcattgaataagtatgaaacggaggcagcagtcgttcaggggttgaacaaacggcaggtctttttgtggattatactgcctcaggtattgctgtcttccattccagccttaacgaatcaggtgattaataaccttaaagacagcaccatcgtttttcttatccaatatactgagtttttcgcgcgaattcaggaggttgctgcaaccagctttaaattcttccatgcttacctttttgccgccatagtgtaccttattggcgttacctttattgtcggtttgacccggtttttagagcatagactgcttcgccattacggtcaggattactgagttgtactgcactattctgattaattcaccgctgacattatcaaagttatttttatttagtgttggttaagattttaaccttcattattgcgttaggtgtccattctggtctaagtcttactccattgaggatattatggcgctaccacaactatccatatggcagcccggcgatgggttaagaaaaataaagtataaatatcatgtttgtctcattgttatattctccgtccttatacggttgctgtttttaactgaccgctacctttggtgtgacgaagcgtccagcgtgctgattagtcgacatagcgtagataatctgctcttccatgccgcttttgacgtgcatcccccgctttattatctgttactgcatgactggatcatattattgggtgatagcattgcagcggtacgctctctcagtctactctttgggatcctgacagttgtgctggttatcgcgcttacgcgatggctggcaaatgaacgtacagccttattggcgggatggttcgccgccctgatgccgatggcagttcattacagtcaagaaacgcgcatgtacgcgttaatgggaatgctaacgctcgctgccgcgttagcattgatgatgtggataaaaacacccacccataatcgctatcttgtcgcgtatgctttacttatgacgttcagcttttacacccattatttcaccctatttacacttattgcccactggatcgcagtaacaatattatcctgccaaagccataaaacggcctgctaccttaaacttcctggctggtggtttgctaacctggcgattgctgtcgcttatctcccctggttgcccgtattgtttaatttactgactcatctggcgcagttgagagccggtaatgatatcggttggattccccccgtaacatggcgtgacctgcctgcgatgtactggcatttttttaccggaaacaacggacagggttttccgtcgttcattctgtggctggctgtgggaggttttatcggtactgtggggcgaatatctttatacaacggagaatatgaaagatatcagctgatattattttgtaatctggtcatccctgtaatgctggtcttcatcatttcctggtggatgccgttatttatcgatcgttatttcttcttctcatcgctgagcattcctcccctgctcgcggtattacttacccgcgcaaaaaaagcggtttgtggcttctggtttatcttattcaccttattattcggctatggttcatatcataataaccctgagcacatagacgagtttaaaccactggtaaactatattaatacccgtcaccagcctaatgatgccgtggtagtcagtaaaatgttcgattatttaagttatgtgtattataataagcgagattatcgtacgtttctttatacaccacctaacgcacacggaacatcaggaagaccgaatgcctatggctttggttcactgttttatgcgcaagccgatcagacatatattgatactctgacaacgctttcaaaaagttaccatcgtgtctggttggtaagcggcggtaacttcagtcaggattaccccttgccgtcagaatggcaaaatatcgcaaaattcagaagtggtagatttcaggtacaattatttgtaataccaactcaacaggcgcgtcaaatgcaatgattaccgttttctatccagtgcagtgataaacagtactgccactgccagaccgcctaaaagtaaggtccagccaaacgcttcaaaaacctcaatcatatcgcctccaggtaggtgatattaaataaagatggctatctcagcgtaacatttaaaatatcaattaatgtgcaataatcgctttatgtgtatgaataaatattgttcctcatgcatttaattgcattgctattatcataaggcttaatatatttatattaacgattattaattatcagcttataataatatgactgtccaattcatttatcagctattattatcctctatattctttaagatagccgtttaattaataatatcgcctttattcatcgcattaaattactcactcacctgattaatgcttgcctaacgattacttcgttgttttaattccagcgcgaaattatttaatgagagaacaatgaagcatacacaacaatcaggcgcaaaagtctataacccattcacgcttagcttatatgactggtgggtactcaatatctcaaacaaatatgcctggaagtgtcctactgatacgcgactacttcctttcttcctgcatcacatgggcgagactcacctggatattggcgtaggtacaggttattacctgaaacatgcacctgcgactcatgccatttcgctgatggatttaaatccggatagcctgaaaatagccgccagccgagtgggtaatacgaaaatccgcgccacactacaacacgatgttttcgacacgttcccggcggactggcacgggcgcttcgattccgtttcgatgtactatcttctgcactgcttacccggtgagatgacaacaaaagcgaaggcaattaaaaatgccggtatggcgctaaaacccggcggcacactttttggcgccacgattctgggcaaagaggttcctcacaatgcttttggtaagaaattaatggctgtttataacaagaaaggaatattcagtaataccaatgattcagccgatacgttacgcagcgtgttggacgaacatttcgctaaggtgactttggagcaacatggcgccgttgcgctattttccgccactatgccacgttcattgtaggtgtaggcacttccgggcggtcggcagcgcgatcatgtgggtttaacccgttgattaaacattggattacggaatagtaattgtttattttatttgtcatacaaataagtataatacccgcttccgatgtagacccgtcctccttcgcctgcgtcacgggtcctggttagacgcaggcgttttctgtatggaatacgccatcccctctgatagatgccttgtttgcctaaagcagttaaccccgcctgtagcaaacgtcatacaggacggtcagttacgcttacgcggcatcatccgtaacagcgtattgtctttccagaaatagtgatgcatcaaagcagcgatggcatgaagtccaataacaaaatagcccagattcgccagcgtgacgtgccaggatttcagcatatctacgcgttcaaagttagcttcggcggcatgcggcatagtaatgccaaatgcgaaccagggattgccgcggttatacatcatgaccagaccaataacaggcagcacgataaataacaggtaaatcaccagatgtcctaaatgcgccattccggtcatcatcggttttggacgaggaacaatgggcggcgtgggatatttcagccgaataatcaagcgcgccaccattaaaagcaaaatagtgataccacatgaaacatgcgtcatattaaactagggccgataactacgcggcgcaaaaccgcgtagctccatcgcggcgtaagccacaataaccagaaaaaagactaaccagtgaataccaatttgcaggccggaatacttattgcccatagcgcgtcctgaatgaaaaccgtaaagcgacaacataaccagcttttataaataattcatcaaatttatgaaatggtggtcgcacttgcccgttcaccctcgcaaacgggcgatttttagcgtaaagctctctgttctaacgcactgcgcagcgtcgtatctgcctgcaatacctgccatgccttttcaatatcgcgtgggatatcaacgtgaatgataaaatctttaccacgcggtccataccctgtttcatcgtcacgcaaacgtggcagctcgccggcaatcagagacagataacgctccaccgtccagatgccctcttcaacgttggcaaaacgtgtaccgccgttaaggtggcgcagtaccggaacaaaaccaggaaaactcagccagcgcggcgcatcggtgtcgtcgtttgtcacgcgccgaaacgccgcgatagtgcgccgctgcatggtggggtcttgcacaacgatagccgtgttaatgttttctttcgcctgacggatcagtgcgcaggagaaacgggcattttcgccgcaattagttgaccgatcttccagccaaattttctcagccggaatatgccagaactggttcgcgatatccgcgaggatagcggcttcagcgcgtccggttgtgcgaatagtatggtagcgcggatgccgggcaatcacggcgtacaaaaacggcgtcgaatgacctataccgccgctaatcagtaaaggaacgccttgcgctttggcgatgcgacaggccgcgtcgatagtggggatcaccgcattgcccgccaggacgacgcaatccgacgaataaggttgttcgccggaaaaatcattttgcgccagccactgtccgacggtattcaccgccagcaatgtttccgcagagagcgccggaaatggcgttgtattcataattcctcctttttgttccgaacttgtaccggatctctttgaaagatatcgtcgcctggctttttaggccgtaatctgatccatggcctgtaaaatacgcttatcggaaataggataaggcgtaccgagctgttgggcgaaataactgacacgcagttcttcaatcatccaacggatctctttaacatcatcatcttcgcgacgcgctggaggcaatttatttatccattgttgccacgcctgctggacgctttcgactttcagcatttgctcccgatcgcggtgcggatcgacagccagtttctccagccgcttttcaattgcctgcagataacgcagcgtatcgccgagacgtttaaagccgttgccagtcacaaaaccacggtataccagaccgctcatctgcgccttgatatcggaaagccccaacgccatgctcatatccacccgccctttcagacgcttattgatattgaatacggtcgtcaggatccgctcaacctgcttcgcgatatccaccacagtatcattcagctcggcgcgtaccttttcgtgcagcgcggtgaaacctgcttcgctccacaccggcccgccgttggcatctatcagcttatctaccccgcaggcgatacagtcatcaatcaactccagtactttgccgtacgggttaaagtacagccccagcttggctttattcggcaatttctcatgcagatacttaatcggtgaaggaatattgagcaacagcagacggcgtaaaccgcaccacatcgcctgttgttgttccagcggattatcaaacaatttgatagcgacgctgtcacgctcatccactaacgccggccacgccttcactttataattaccgcgtttctgttcgtagctttccggcagctcgccgaaactccagatatgcagcccgctctgctcgatgccgtcatccgctaccgccgagagcgtctcctgcactttgcctttcagcgcatttttaagctcggcgagcgaacgcccttcctgcagtttcttgtttttgtcattcaccacgcgaaacgtgattttcagatgctcgggcacctgatcccaatgccagtcttcccgatcgaccgtgacgccggtcatccggcgcagttcacgctccagagcgtccagcagcggcagctccagcggcgttacgcgacctaaaaacgcttcagcatagtttggcgccggaacaaagttgcgacgtaccggttttggcaacgatttaatcagcgcaatcactaattcacggcgcagccctgggatctgccattcaaaaccgctctcgtcaacctggttaagtagcggcaacggaatatggacggtcacgccgtcagcatccgcgcccggttcaaactgatagctcaaacgcagcttgagattgccctggtgccagaaattcgggtaatccagtttgctgattttttccgcgccttctttaatcagcatacttttttcaaagttgagcagatccggcgtctcgcggctgatttttttccaccaactatcaaagtggcgggcggaaataacgtcatggctaatacgctggtcataaaactcaaacagggtatcgtcatccaccaggatatcgcggcggcgagatttgtgctcaagttcctcgacttccgcacgcaattttagattctcacggaagaaggcgtgacgggtttgccagtccccctccaccagcgcatggcggataaacaactcgcgacacaacgccgggtcaatctggctataattcaccttgcgcgcggcgacaatcggcagaccgtagacagtaaccttttccgtcgccatcaccgcgccttgcgcccgctcccagtgcggttcgctatatgaacgtttaatcaggtgctgggctaccggttccacccattctggctcaatgcgggcagcgatgcgcccccacaaacggctggtttccaccagctcggcgaccattgtccatttcggcggttttttgaataaaccggatccggggaaaatagagaatcgggcgttacgcgcgccggtgtactcttgtttatcggcatctttcatcccgatatgcgacaacagccccgttaacaacgcaacgtgaatttcccggtattctgcgggttcgctgtttaccggaatccccagttcttttaccacctgacgcagttgggta
